United States Patent
Fitzgerald et al.

(10) Patent No.: US 10,767,177 B2
(45) Date of Patent: Sep. 8, 2020

(54) STEROL REGULATORY ELEMENT BINDING PROTEIN (SREBP) CHAPERONE (SCAP) IRNA COMPOSITIONS AND METHODS OF USE THEREOF

(71) Applicant: Alnylam Pharmaceuticals, Inc., Cambridge, MA (US)

(72) Inventors: Kevin Fitzgerald, Brookline, MA (US); Huilei Xu, Boston, MA (US); Gregory Hinkle, Plymouth, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 16/002,034

(22) Filed: Jun. 7, 2018

(65) Prior Publication Data
US 2018/0273955 A1 Sep. 27, 2018

Related U.S. Application Data

(63) Continuation of application No. PCT/US2016/065781, filed on Dec. 9, 2016.

(60) Provisional application No. 62/378,964, filed on Aug. 24, 2016, provisional application No. 62/265,580, filed on Dec. 10, 2015.

(51) Int. Cl.
*C12N 15/113* (2010.01)
*A61K 31/713* (2006.01)
*A61K 47/54* (2017.01)

(52) U.S. Cl.
CPC .......... *C12N 15/113* (2013.01); *A61K 31/713* (2013.01); *A61K 47/549* (2017.08); *A61K 47/554* (2017.08); *C12N 2310/14* (2013.01); *C12N 2310/315* (2013.01); *C12N 2310/318* (2013.01); *C12N 2310/346* (2013.01); *C12N 2310/351* (2013.01); *C12N 2310/3515* (2013.01)

(58) Field of Classification Search
None
See application file for complete search history.

(56) References Cited

U.S. PATENT DOCUMENTS

2009/0093426 A1* 4/2009 Soutschek ............ C12N 15/113
514/44 R

FOREIGN PATENT DOCUMENTS

| JP | 2007325525 A | 12/2007 |
|---|---|---|
| WO | WO-2008/036638 A2 | 3/2008 |
| WO | WO-2013/075035 A1 | 5/2013 |

OTHER PUBLICATIONS

Moon et al., "The Scap/SREBP Pathway Is Essential for Developing Diabetic Fatty Liver and Carbohydrate-Induced Hypertriglyceridemia in Animals", Cell Metabolism 15, pp. 240-246, Feb. 8, 2012.
Choi et al., "Overexpression of A-kinase anchoring protein 12A activates sterol regulatory element binding protein-2 and enhances cholesterol efflux in hepatic cells", The International Journal of Biochemistry & Cell Biology, vol. 40(11):2534-2543, 2008.
Zhou et al., "Vascular Endothelial Growth Factor Activation of Sterol Regulatory Element Binding Protein", Circ Res. vol. 95:471-478, 2004.
Zhou et al., "Enhanced sterol response element-binding protein in postintervention restenotic blood vessels plays an important role in vascular smooth muscle proliferation", Life Science, vol. 82(3-4):174-181, 2008.
International Preliminary Report on Patentability from PCT/US2016/065781 dated Jun. 12, 2018.

* cited by examiner

*Primary Examiner* — Sean McGarry
(74) *Attorney, Agent, or Firm* — McCarter & English, LLP; Maria Laccotripe Zacharakis; Deborah L. Nagle

(57) ABSTRACT

The invention relates to double stranded ribonucleic acid (dsRNAi) agents and compositions targeting the SCAP gene, as well as methods of inhibiting expression of a SCAP gene and methods of treating subjects having a SCAP-associated disorder, such as nonalcoholic fatty liver disease (NAFLD) or nonalcoholic steatohepatitis (NASH), using such dsRNAi agents and compositions.

59 Claims, No Drawings
Specification includes a Sequence Listing.

STEROL REGULATORY ELEMENT BINDING PROTEIN (SREBP) CHAPERONE (SCAP) IRNA COMPOSITIONS AND METHODS OF USE THEREOF

RELATED APPLICATIONS

This application is a 35 § U.S.C. 111(a) continuation application which claims the benefit of priority to PCT/US2016/065781, filed on Dec. 9, 2016, which claims the benefit of priority to U.S. Provisional Patent Application No. 62/265,580, filed on Dec. 10, 2015, and to U.S. Provisional Patent Application No. 62/378,964, filed on Aug. 24, 2016. The entire contents of each of the foregoing patent applications are hereby incorporated herein by reference.

SEQUENCE LISTING

The instant application contains a Sequence Listing which has been filed electronically in ASCII format and is hereby incorporated by reference in its entirety. Said ASCII copy, created on Jun. 5, 2018, is named 121301-05003_SL.txt and is 606,698 bytes in size.

BACKGROUND OF THE INVENTION

The accumulation of excess triglyceride in the liver is known as hepatic steatosis (or fatty liver), and is associated with adverse metabolic consequences, including insulin resistance and dyslipidemia. Fatty liver is frequently found in subjects having excessive alcohol intake and subjects having obesity, diabetes, or hyperlipidemia. However, in the absence of excessive alcohol intake (>10 g/day), nonalcoholic fatty liver disease (NAFLD) can develop. NAFLD refers to a wide spectrum of liver diseases that can progress from simple fatty liver (steatosis), to nonalcoholic steatohepatitis (NASH), to cirrhosis (irreversible, advanced scarring of the liver). All of the stages of NAFLD have in common the accumulation of fat (fatty infiltration) in the liver cells (hepatocytes).

The NAFLD spectrum begins with and progress from its simplest stage, called simple fatty liver (steatosis). Simple fatty liver involves the accumulation of fat (triglyceride) in the liver cells with no inflammation (hepatitis) or scarring (fibrosis). The next stage and degree of severity in the NAFLD spectrum is NASH, which involves the accumulation of fat in the liver cells, as well as inflammation of the liver. The inflammatory cells destroy liver cells (hepatocellular necrosis), and NASH ultimately leads to scarring of the liver (fibrosis), followed by irreversible, advanced scarring (cirrhosis). Cirrhosis that is caused by NASH is the last and most severe stage in the NAFLD spectrum.

NAFLD is now the leading cause of chronic liver disease in the United States and there are currently about 1 million patients diagnosed with NASH. Subjects having NASH have a doubled risk of cardiovascular mortality as compared to the general population and NASH is the third most common cause of liver transplantation.

A central element in the regulation of lipid biosynthesis in the human liver is a group of transcription factors termed Sterol Regulatory Element Binding Proteins (SREBPs). There are three SREBP isoforms called SREBP-1a, SREBP-1c and SREBP-2. They are located in the endoplasmatic reticulum (ER) in precursor form (Yokoyama C. et al., *Cell* 1993, 75:187; Hua X. et al., *Proc. Natl. Acad. Sci.* 1993, 90:11603) which, in the presence of cholesterol, is bound to cholesterol and two other proteins: SCAP (SREBF chaperone) and Insig1 (Insulin-induced gene 1). When cholesterol levels fall, Insig-1 dissociates from the SREBP-SCAP complex, allowing the complex to migrate to the Golgi apparatus, where SREBP is cleaved by S1P and S2P (site 1/2 protease; Sakai J et al, *Mol. Cell.* 1998, 2:505; Rawson R. B. et al, *Mol. Cell.* 1997, 1:47), two enzymes that are activated by SCAP. The cleaved SREBP then migrates to the nucleus and acts as a transcription factor by binding to the SRE (sterol regulatory element) of a number of genes and stimulating their transcription (Briggs M. R. et al., *J. Biol. Chem.* 1993, 268:14490). Among the genes transcribed are the LDL-Receptor, up-regulation of which leads to increased in-flux of cholesterol from the bloodstream, HMG-CoA reductase, the rate limiting enzyme in de-novo cholesterol synthesis (Anderson et al, *Trends Cell Biol* 2003, 13:534), as well as a number of genes involved in fatty acid synthesis, e.g., Patatin-Like Phospholipase Domain Containing 3 (PN-PLA3), which is a multifunctional enzyme which has both triacylglycerol lipase (triglyceride hydrolysis) and acylglycerol O-acyltransferase activities (triglyceride synthesis).

Since SCAP-binding is a prerequisite for the transport and activation of all three SREBP isoforms, inhibition of the expression and/or activity of SCAP with an agent that can selectively and efficiently attenuate the body's own lipid biosynthesis, e.g. by inhibiting SCAP, and thereby SREBP activity, would be useful for treating pathological processes mediated directly or indirectly by SCAP expression.

Currently, treatments for NAFLD are directed towards weight loss and treatment of any secondary conditions, such as insulin resistance or dyslipidemia. However, to date, no pharmacologic treatments for NAFLD have been approved. Therefore, there is a need for therapies for subjects suffering from NAFLD, e.g., steatosis and NASH.

SUMMARY OF THE INVENTION

The present invention provides iRNA compositions which effect the RNA-induced silencing complex (RISC)-mediated cleavage of RNA transcripts of a sterol regulatory element binding protein (SREBP) chaperone (SCAP) gene. The SCAP gene may be within a cell, e.g., a cell within a subject, such as a human. The present invention also provides methods of using the iRNA compositions of the invention for inhibiting the expression of a SCAP gene and/or for treating a subject who would benefit from inhibiting or reducing the expression of a SCAP gene, e.g., a subject suffering or prone to suffering from a SCAP-associated disease, for example, Nonalcoholic Fatty Liver Disease (NAFLD), e.g., nonalcoholic steatohepatitis (NASH).

Accordingly, in one aspect, the present invention provides double stranded ribonucleic acids (RNAi) agents for inhibiting expression of a sterol regulatory element binding protein (SREBP) chaperone (SCAP) gene. The double stranded RNAi agents include a sense strand and an antisense strand, wherein the sense strand comprises at least 15 contiguous nucleotides differing by no more than 3 nucleotides from any one of the nucleotide sequences of SEQ ID NOs:1-13, wherein the antisense strand comprises at least 15 contiguous nucleotides differing by no more than 3 nucleotides from any one of the nucleotide sequences of SEQ ID NOs:14-26.

In another aspect, the present invention provides a double stranded ribonucleic acid (RNAi) agent for inhibiting epression of a SCAP gene, wherein the double stranded RNAi agent comprises a sense strand and an antisense strand, wherein the antisense strand comprising a region of complementarity which comprises at least 15 contiguous nucleotides differing by no more than 3 nucleotides from any one of the antisense sequences listed in any one of Tables 2, 3, 5 and 6.

In some embodiments, the sense and antisense strands of the double stranded RNAi agent of the present invention comprise sequences selected from the group consisting of any one of the sequences in any one of Tables 2, 3, 5 and 6.

In some aspects, the sense strand comprises at least 15 contiguous nucleotides differnting by no more than 3 nucleotides from the nucleotide sequence of nucleotides 345-363, 378-396, 383-401, 402-420, 437-455, 458-476, 491-509, 1014-1032, 1237-1255, 1243-1261, 1259-1277, 1318-1336, 1323-1341, 1497-1515, 1571-1589, 1588-1606, 1605-1623, 1725-1743, 1767-1785, 1946-1964, 2004-2022, 2160-2178, 2193-2211, 2217-2235, 2517-2535, 2547-2565, 2616-2634, 2663-2681, 2717-2735, 2734-2752, 2751-2769, 2874-2892, 2885-2903, 2998-3016, 3276-3294, 3292-3310, 3325-3343, 3342-3360, 3420-3438, 3469-3487, 3478-3496, 3533-3551, 3549-3567, 3565-3583, 3579-3597, 3622-3640, 3667-3685, 3771-3789, 3788-3806, 3871-3889, 3891-3909, 3904-3922, 3921-3939, 4002-4020, 4010-4028, 4027-4045, 4075-4093, 4129-4147, 4145-4163, 4149-4167, 4168-4186, 4184-4202 and 4197-4215 of SEQ ID NO: 2.

In some embodiments, the antisense strand comprises at least 15 contiguous nucleotides differing by no more than 3 nucleotides from the antisense nucleotide sequence of a duplex selected from the group consisting of AD-77633, AD-77631, AD-77630, AD-77629, AD-77627, AD-77625, AD-77624, AD-77587, AD-77573, AD-77572, AD-77571, AD-77567, AD-77566, AD-77738, AD-77731, AD-77730, AD-77729, AD-77721, AD-77718, AD-77706, AD-77701, AD-77690, AD-77688, AD-77686, AD-77669, AD-77667, AD-77662, AD-77660, AD-77656, AD-77655, AD-77654, AD-77555, AD-77554, AD-77547, AD-77530, AD-77529, AD-77527, AD-77526, AD-77521, AD-77519, AD-77518, AD-77514, AD-77513, AD-77512, AD-77510, AD-77507, AD-77505, AD-77499, AD-77498, AD-77494, AD-77492, AD-77491, AD-77490, AD-77486, AD-77485, AD-77484, AD-77483, AD-77479, AD-77478, AD-77477, AD-77476, AD-77475 and AD-77474 as listed in Tables 5 and 6.

In certain embodiments, the double stranded RNAi agent comprises at least one modified nucleotide. In certain embodiments, the double stranded RNAi agent comprises no more than 4 (i.e., 4, 3, 2, 1, or 0) unmodified nucleotides in the sense strand. In certain embodiments, the double stranded RNAi agent comprises no more than 4 (i.e., 4, 3, 2, 1, or 0) unmodified nucleotides in the antisense strand. In certain embodiments, the dsRNA agent comprises no more than 4 (i.e., 4, 3, 2, 1, or 0) unmodified nucleotides in both the sense strand and the antisense strand. In certain embodiments, substantially all of the nucleotides in the sense strand of the double stranded RNAi agent are modified nucleotides. In certain embodiments, substantially all of the nucleotides in the antisense strand of the double stranded RNAi agent are modified nucleotides. In certain embodiments, all of the nucleotides in the sense strand of the double stranded RNAi agent and all of the nucleotides of the antisense strand are modified nucleotides.

In certain embodiments, the modified nucleotide(s) is/are independently selected from the group consisting of a 2'-O-methyl modified nucleotide, a nucleotide comprising a 5'-phosphorothioate group, and a terminal nucleotide linked to a cholesteryl derivative or a dodecanoic acid bisdecylamide group.

In one embodiment, the modified nucleotide is selected from the group consisting of a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a 5'-phosphorothioate group, a nucleotide comprising a 5'-methylphosphonate group, a nucleotide comprising a 5' phosphate or 5' phosphate mimic, a nucleotide comprising vinyl phosphate, a nucleotide comprising adenosine-glycol nucleic acid (GNA), a nucleotide comprising thymidine-glycol nucleic acid (GNA) S-Isomer, a nucleotide comprising 2-hydroxymethyl-tetrahydrofurane-5-phosphate, a nucleotide comprising 2'-deoxythymidine-3'phosphate, a nucleotide comprising 2'-deoxyguanosine-3'-phosphate, and a terminal nucleotide linked to a cholesteryl derivative and a dodecanoic acid bisdecylamide group In certain embodiments, the modified nucleotide is selected from the group consisting of a 2'-deoxy-2'-fluoro modified nucleotide, a 2'-deoxy-modified nucleotide, a locked nucleotide, an abasic nucleotide, a 2'-amino-modified nucleotide, a 2'-alkyl-modified nucleotide, a morpholino nucleotide, a phosphoramidate, and a non-natural base comprising nucleotide. In some embodiments, the modified nucleotides comprise a short sequence of 3'-terminal deoxy-thymine nucleotides (dT). In certain embodiments, the modifications on the nucleotides are 2'-O-methyl and 2'-fluoro modifications.

In some embodiments, the double stranded RNAi agent further comprises at least one phosphorothioate internucleotide linkage. In some embodiments, the double stranded RNAi agent comprises 6-8 phosphorothioate internucleotide linkages, e.g., 6, 7, or 8 phosphorothioate internucleotide linkages.

In certain embodiments, the double stranded RNAi agent comprises a region of complementarity at least 17 nucleotides in length. In certain embodiments, the double stranded RNAi agent comprises a region of complementarity 19 and 23 nucleotides in length. In certain embodiments, the double stranded RNAi agent comprises a region of complementarity is 19 nucleotides in length.

In certain embodiments, each strand of the double stranded RNAi agent is no more than 30 nucleotides in length. In certain embodiments, the double stranded RNAi agent is at least 15 nucleotides in length.

In certain embodiments, at least one strand of the double stranded RNAi agent comprises a 3' overhang of at least 1 nucleotide. In certain embodiments, the at least one strand comprises a 3' overhang of at least 2 nucleotides.

In some embodiment, the double stranded RNAi agent further comprises a ligand. In one embodiment, the ligand is conjugated to the 3' end of the sense strand of the double stranded RNAi agent. In one embodiment, the ligand is conjugated to the 3'end of the sense strand through a monovalent or a branched bivalent or trivalent linker. In one embodiment, the ligand is an N-acetylgalactosamine (GalNAc) derivative conjugated to the 3' end of the sense strand of the double stranded RNAi agent. In certain embodiments, the ligand is conjugated to the 3' end of the sense strand of the double stranded RNAi agent through a branched bivalent or trivalent linker. In certain embodiments, the ligand is

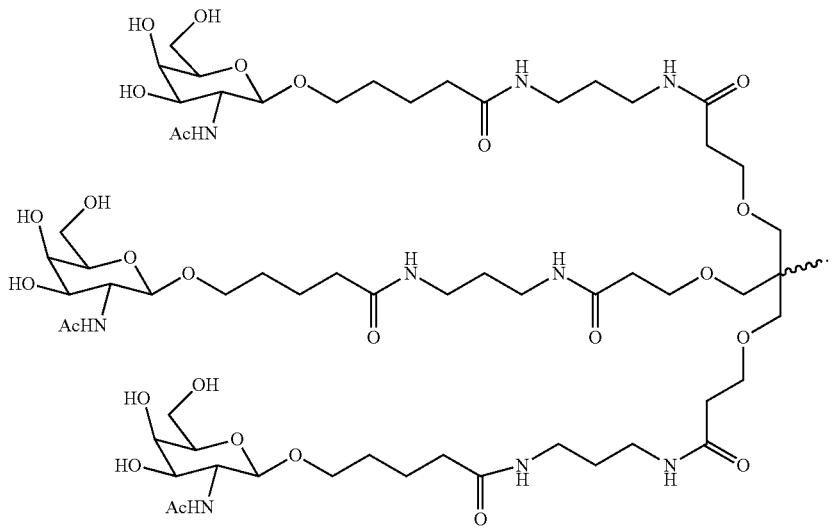 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In certain embodiments, the double stranded RNAi agent is conjugated to the ligand as shown in the following schematic

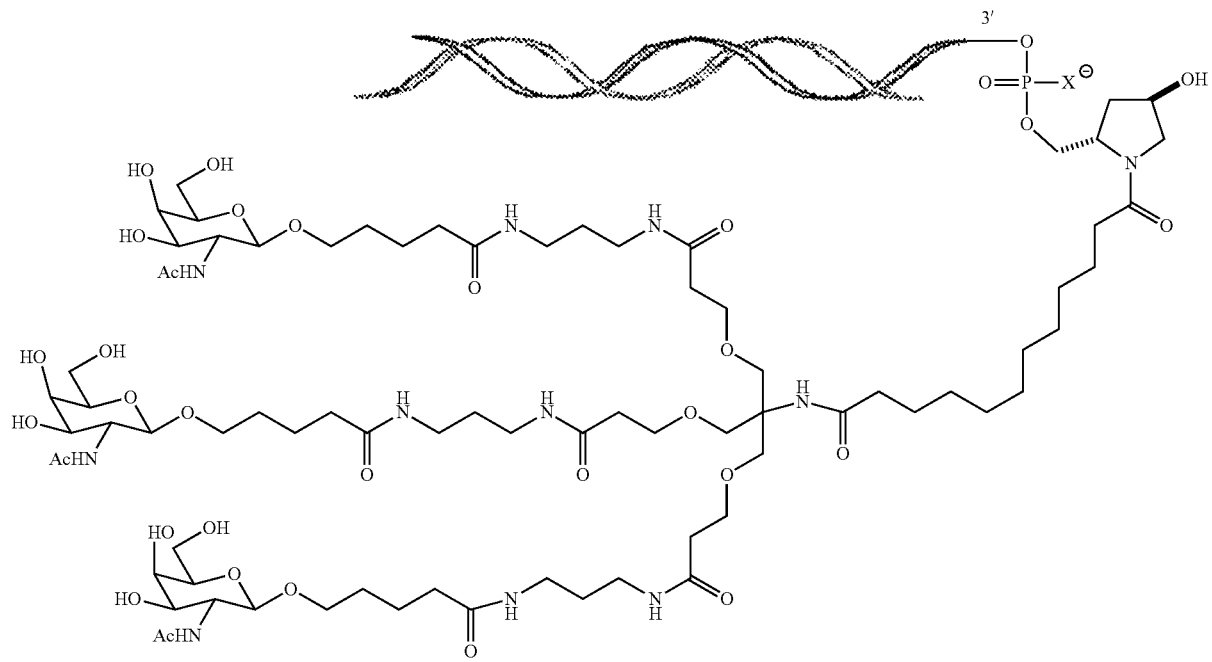

and, wherein X is O or S.

In some embodiments, the X is O. In certain embodiments, the ligand is a cholesterol.

In some embodiments, the region of complementarity comprises any one of the antisense sequences in any one of Table 2, Table 3, Table 5 and Table 6. In other embodiments, the region of complementarity consists of any one of the antisense sequences in any ne of Table 2, Table 3, Table 5 and Table 6.

In one aspect, the invention provides a double stranded ribonucleic acid (RNAi) agent for inhibiting expression of a sterol regulatory element binding protein (SREBP) chaperone (SCAP) gene, wherein the double stranded RNAi agent comprises a sense strand complementary to an antisense strand, wherein the antisense strand comprises a region complementary to part of an mRNA encoding SCAP, wherein each strand is about 14 to about 30 nucleotides in length, wherein the double stranded RNAi agent is represented by formula (III):

sense: 5'$n_p$-$N_a$-(XXX)$_i$-$N_b$-YYY-$N_b$-(ZZZ)$_j$-$N_a$-$n_q$3' antisense: 3'$n_p'$-$N_a'$-(X'X'X')$_k$-$N_b'$-Y'Y'Y'-$N_b'$-(Z'Z'Z')$_l$-$N_a'$-$n_q'$5'  (III)

wherein: i, j, k, and l are each independently 0 or 1; p, p', q, and q' are each independently 0-6; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; each $n_p$, $n_p'$, $n_q$, and $n_q'$ each of which may or may not be present, independently represents an overhang nucleotide; XXX, YYY, ZZZ, X'X'X', Y'Y'Y', and Z'Z'Z' each independently represent one motif of three identical modifications on three consecutive nucleotides;

modifications on $N_b$ differ from the modification on Y and modifications on $N_b'$ differ from the modification on Y'; and wherein the sense strand is conjugated to at least one ligand.

In some embodiments, i is 0; j is 0; i is 1; j is 1; both i and j are 0; or both i and j are 1. In some embodiments, k is 0; l is 0; k is 1; l is 1; both k and l are 0; or both k and l are 1.

In some embodiments, XXX is complementary to X'X'X', YYY is complementary to Y'Y'Y', and ZZZ is complementary to Z'Z'Z'. In some embodiments, the YYY motif occurs at or near the cleavage site of the sense strand. In some embodiments, the Y'Y'Y' motif occurs at the 11, 12 and 13 positions of the antisense strand from the 5'-end. In some embodiments, the Y' is 2'-O-methyl.

In some embodiments, formula (III) is represented by formula (IIIa):

sense: 5'$n_p$-$N_a$-YYY-$N_a$-$n_q$3' antisense: 3'$n_p'$-$N_a$-Y'Y'Y'-$N_a$-$n_q'$5'          (IIIa).

In some embodiments, formula (III) is represented by formula (IIIb):

sense: 5'$n_p$-$N_a$-YYY-$N_b$-ZZZ-$N_a$-$n_q$3' antisense: 3'$n_p'$-$N_a$-$N_a$-$n_q'$5'          (IIIb)

wherein each $N_b$ and $N_b'$ independently represents an oligonucleotide sequence comprising 1-5 modified nucleotides.

In some embodiments, formula (III) is represented by formula (IIIc):

sense: 5'$n_p$-$N_a$-XXX-$N_b$-YYY-$N_a$-$n_q$3' antisense: 3'$n_p'$-$N_a$-X'X'X'-$N_b$-Y'Y'Y'-$N_a$-$n_q'$5'          (IIIc)

wherein each $N_b$ and $N_b'$ independently represents an oligonucleotide sequence comprising 1-5 modified nucleotides.

In some embodiments, formula (III) is represented by formula (IIId):

sense: 5'$n_p$-$N_a$-XXX-$N_b$-YYY-$N_b$-ZZZ-$N_a$-$n_q$3' antisense: 3'$n_p'$-$N_a$-XXX'-$N_b$-Y'Y'Y'-$N_b$-Z'Z'Z'-$N_a$-$n_q'$5'          (IIId)

wherein each $N_b$ and $N_b'$ independently represents an oligonucleotide sequence comprising 1-5 modified nucleotides and each $N_a$ and $N_a'$ independently represents an oligonucleotide sequence comprising 2-10 modified nucleotides.

In some embodiments, the double stranded region is 15-30 nucleotide pairs in length. In some embodiments, the double stranded region is 17-23 nucleotide pairs in length. In some embodiments, the double stranded region is 17-25 nucleotide pairs in length. In some embodiments, the double stranded region is 23-27 nucleotide pairs in length. In some embodiments, the double stranded region is 19-21 nucleotide pairs in length. In some embodiments, the double stranded region is 21-23 nucleotide pairs in length. In some embodiments, each strand has 15-30 nucleotides. In some embodiments, each strand has 19-30 nucleotides.

In some embodiments, the modifications on the nucleotides are selected from the group consisting of LNA, HNA, CeNA, 2'-methoxyethyl, 2'-O-alkyl, 2'-O-allyl, 2'-C-allyl, 2'-fluoro, 2'-deoxy, 2'-hydroxyl, and combinations thereof. In some embodiments, the modifications on the nucleotides are 2'-O-methyl or 2'-fluoro modifications.

In some embodiments, the ligand is one or more GalNAc derivatives attached through a bivalent or trivalent branched linker; or a cholesterol.

In some embodiments, the ligand is

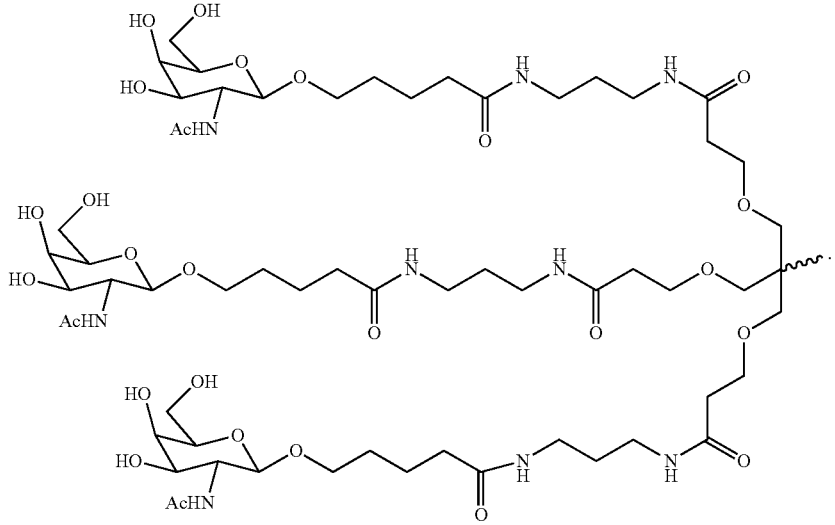 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In some embodiments, the ligand is attached to the 3' end of the sense strand. In some embodiments, the RNAi agent is conjugated to the ligand as shown in the following schematic

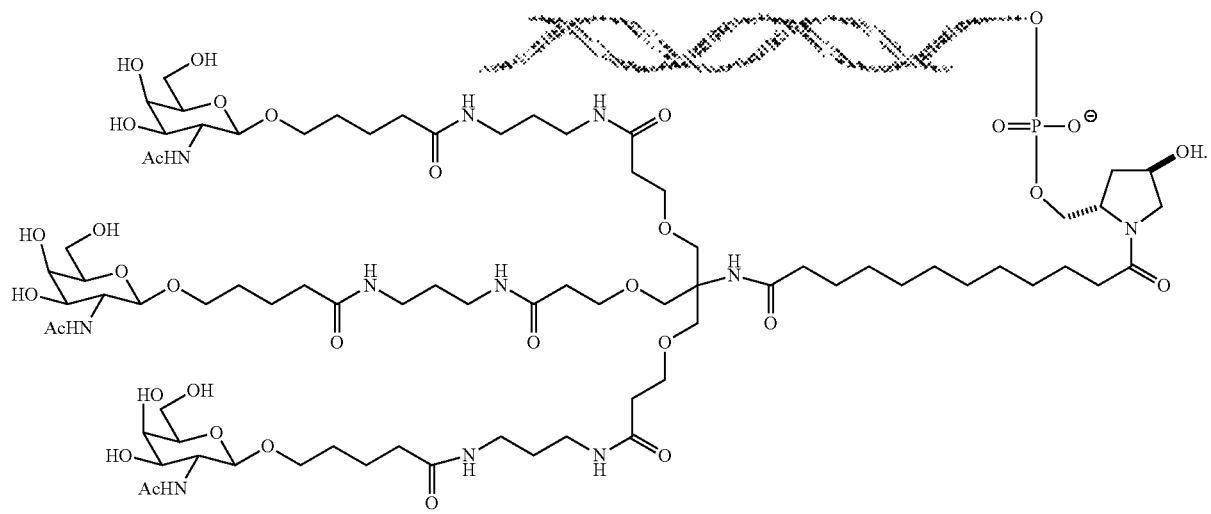 [SMILES: CC(=O)NC1C(OCCCCC(=O)NCCCNC(=O)CCOCC(COCCC(=O)NCCCNC(=O)CCCCOC2OC(CO)C(O)C(O)C2NC(C)=O)(COCCC(=O)NCCCNC(=O)CCCCOC2OC(CO)C(O)C(O)C2NC(C)=O)NC(=O)CCCCCCCCCCC(=O)N2C[C@H](O)C[C@H]2COP(=O)([O-])O)OC(CO)C(O)C1O]

In some embodiments, the agent further comprises at least one phosphorothioate or methylphosphonate internucleotide linkage. In some embodiments, the phosphorothioate or methylphosphonate internucleotide linkage is at the 3'-terminus of one strand. In some embodiments, the strand is the antisense strand. In some embodiments, the strand is the sense strand.

In some embodiments, the phosphorothioate or methylphosphonate internucleotide linkage is at the 5'-terminus of one strand. In some embodiments, strand is the antisense strand. In some embodiments, strand is the sense strand.

In some embodiments, the phosphorothioate or methylphosphonate internucleotide linkage is at the both the 5'- and 3'-terminus of one strand. In some embodiments, strand is the antisense strand.

In some embodiments, the base pair at the 1 position of the 5'-end of the antisense strand of the duplex is an AU base pair. In some embodiments, the Y nucleotides contain a 2'-fluoro modification. In some embodiments, the Y' nucleotides contain a 2'-O-methyl modification. In some embodiments, p'>0. In some embodiments, p'=2. In some embodiments, q'=0, p=0, q=0, and p' overhang nucleotides are complementary to the target mRNA. In some embodiments, q'=0, p=0, q=0, and p' overhang nucleotides are non-complementary to the target mRNA.

In some embodiments, the sense strand has a total of 21 nucleotides and the antisense strand has a total of 23 nucleotides. In some embodiments, at least one $n_p'$ is linked to a neighboring nucleotide via a phosphorothioate linkage. In some embodiments, all $n_p'$ are linked to neighboring nucleotides via phosphorothioate linkages.

In some embodiments, the RNAi agent is selected from the group of RNAi agents listed in any one of Table 2, Table 3, Table 5 and Table 6. In some embodiments, all of the nucleotides of the sense strand and all of the nucleotides of the antisense strand comprise a modification.

In another aspect, the invention provides cells containing the double stranded RNAi agents provided herein.

In yet another aspect, the invention provides pharmaceutical compositions for inhibiting expression of a SCAP gene. The compositions include the double stranded RNAi agents provided herein. In certain embodiments, the RNAi agent is administered in an unbuffered solution. In some embodiments, the unbuffered solution is saline or water. In other embodiments, the RNAi agent is administered with a buffer solution. In some embodiments, the buffer solution comprises acetate, citrate, prolamine, carbonate, or phosphate or any combination thereof. In some embodiments, the buffer solution is phosphate buffered saline (PBS). In some embodiments, the pharmaceutical compositions further comprise a lipid formulation. In some embodiments, the lipid formulation comprises a LNP. In some embodiments, the lipid formulation comprises a MC3.

In one aspect, the present invention provides a double stranded RNAi agent inhibiting expression of a sterol regulatory element binding protein (SREBP) chaperone (SCAP) gene in a cell, wherein the double stranded RNAi agent comprises a sense strand complementary to an antisense strand, wherein the antisense strand comprises a region complementary to part of an mRNA encoding SCAP, wherein each strand is about 14 to about 30 nucleotides in length, wherein the double stranded RNAi agent is represented by formula (III):

sense: 5'$n_p$-$N_a$-(XXX)$_i$-$N_b$-YYY-$N_b$-(ZZZ)$_j$-$N_a$-$n_q$3' antisense: 3'$n_p'$-$N_a'$-(X'X'X')$_k$-$N_b'$-Y'Y'Y'-$N_b'$-(Z'Z'Z')$_l$-$N_a'$-$n_q'$5' (III)

wherein: i, j, k, and l are each independently 0 or 1; p, p', q, and q' are each independently 0-6; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; each $n_p$, $n_p'$, $n_q$, and $n_q'$, each of which may or may not be present independently represents an overhang nucleotide; XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications; modifications on $N_b$ differ from the modification on Y and modifications on $N_b'$ differ from the modification on Y'; and wherein the sense strand is conjugated to at least one ligand.

In another aspect, the present invention provides a double stranded RNAi agent inhibiting expression of a sterol regulatory element binding protein (SREBP) chaperone (SCAP) gene in a cell, wherein the double stranded RNAi agent comprises a sense strand complementary to an antisense strand, wherein the antisense strand comprises a region complementary to part of an mRNA encoding SCAP, wherein each strand is about 14 to about 30 nucleotides in length, wherein the double stranded RNAi agent is represented by formula (III):

sense: $5'n_p\text{-}N_a\text{-}(XXX)_i\text{-}N_b\text{-}YYY\text{-}N_b\text{-}(ZZZ)_j\text{-}N_a\text{-}n_q 3'$ antisense: $3'n_p'\text{-}N_a'\text{-}(X'X'X')_k\text{-}N_b'\text{-}Y'Y'Y'\text{-}N_b'\text{-}(Z'Z'Z')_l\text{-}N_a'\text{-}n_q'5'$ (III)

wherein: i, j, k, and l are each independently 0 or 1; each $n_p$, $n_q$, and $n_q'$, each of which may or may not be present, independently represents an overhang nucleotide; p, q, and q' are each independently 0-6; $n_p'>0$ and at least one $n_p'$ is linked to a neighboring nucleotide via a phosphorothioate linkage; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications; modifications on $N_b$ differ from the modification on Y and modifications on $N_b'$ differ from the modification on Y'; and wherein the sense strand is conjugated to at least one ligand.

In another aspect, the present invention provides a double stranded RNAi agent inhibiting expression of a sterol regulatory element binding protein (SREBP) chaperone (SCAP) gene in a cell, wherein the double stranded RNAi agent comprises a sense strand complementary to an antisense strand, wherein the antisense strand comprises a region complementary to part of an mRNA encoding SCAP, wherein each strand is about 14 to about 30 nucleotides in length, wherein the double stranded RNAi agent is represented by formula (III):

sense: $5'n_p\text{-}N_a\text{-}(XXX)_i\text{-}N_b\text{-}YYY\text{-}N_b\text{-}(ZZZ)_j\text{-}N_a\text{-}n_q 3'$ antisense: $3'n_p'\text{-}N_a'\text{-}(X'X'X')_k\text{-}N_b'\text{-}Y'Y'Y'\text{-}N_b'\text{-}(Z'Z'Z')_l\text{-}N_a'\text{-}n_q'5'$ (III)

wherein: i, j, k, and l are each independently 0 or 1; each $n_p$, $n_q$, and $n_q'$, each of which may or may not be present, independently represents an overhang nucleotide; p, q, and q' are each independently 0-6; $n_p'>0$ and at least one $n_p'$ is linked to a neighboring nucleotide via a phosphorothioate linkage; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications; modifications on $N_b$ differ from the modification on Y and modifications on $N_b'$ differ from the modification on Y'; and wherein the sense strand is conjugated to at least one ligand, wherein the ligand is one or more GalNAc derivatives attached through a bivalent or trivalent branched linker.

In yet another aspect, the present invention provides a double stranded RNAi agent inhibiting expression of a sterol regulatory element binding protein (SREBP) chaperone (SCAP) gene in a cell, wherein the double stranded RNAi agent comprises a sense strand complementary to an antisense strand, wherein the antisense strand comprises a region complementary to part of an mRNA encoding SCAP, wherein each strand is about 14 to about 30 nucleotides in length, wherein the double stranded RNAi agent is represented by formula (III):

sense: $5'n_p\text{-}N_a\text{-}(XXX)_i\text{-}N_b\text{-}YYY\text{-}N_b\text{-}(ZZZ)_j\text{-}N_a\text{-}n_q 3'$ antisense: $3'n_p'\text{-}N_a'\text{-}(X'X'X')_k\text{-}N_b'\text{-}Y'Y'Y'\text{-}N_b'\text{-}(Z'Z'Z')_l\text{-}N_a'\text{-}n_q'5'$ (III)

wherein: i, j, k, and l are each independently 0 or 1; each $n_p$, $n_q$, and $n_q'$, each of which may or may not be present, independently represents an overhang nucleotide; p, q, and q' are each independently 0-6; $n_p'>0$ and at least one $n_p'$ is linked to a neighboring nucleotide via a phosphorothioate linkage; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications; modifications on $N_b$ differ from the modification on Y and modifications on $N_b'$ differ from the modification on Y'; herein the sense strand comprises at least one phosphorothioate linkage; and wherein the sense strand is conjugated to at least one ligand, wherein the ligand is one or more GalNAc derivatives attached through a bivalent or trivalent branched linker.

In another aspect, the present invention provides a double stranded RNAi agent inhibiting expression of a sterol regulatory element binding protein (SREBP) chaperone (SCAP) gene in a cell, wherein the double stranded RNAi agent comprises a sense strand complementary to an antisense strand, wherein the antisense strand comprises a region complementary to part of an mRNA encoding SCAP, wherein each strand is about 14 to about 30 nucleotides in length, wherein the double stranded RNAi agent is represented by formula (III):

sense: $5'n_p\text{-}N_a\text{-}YYY\text{-}N_a\text{-}n_q 3'$ antisense: $3'n_p'\text{-}N_a'\text{-}Y'Y'Y'\text{-}N_a'\text{-}n_q'5'$ (IIIa)

wherein: each $n_p$, $n_q$, and $n_q'$, each of which may or may not be present, independently represents an overhang nucleotide; p, q, and q' are each independently 0-6; $n_p'>0$ and at least one $n_p'$ is linked to a neighboring nucleotide via a phosphorothioate linkage; each $N_a$ and $N_a'$ independently represents an oligonucleotide sequence comprising 0-25 nucleotides which are either modified or unmodified or combinations thereof, each sequence comprising at least two differently modified nucleotides; YYY and Y'Y'Y' each independently represent one motif of three identical modifications on three consecutive nucleotides, and wherein the modifications are 2'-O-methyl or 2'-fluoro modifications; wherein the sense strand comprises at least one phosphorothioate linkage; and wherein the sense strand is conjugated to at least one ligand, wherein the ligand is one or more GalNAc derivatives attached through a bivalent or trivalent branched linker.

In one aspect, the present invention provides a double stranded RNAi agent inhibiting expression of a sterol regulatory element binding protein (SREBP) chaperone (SCAP) gene in a cell, wherein the double stranded RNAi agent comprises a sense strand complementary to an antisense strand, wherein the antisense strand comprises a region complementary to part of an mRNA encoding SCAP, wherein each strand is about 14 to about 30 nucleotides in length, wherein the double stranded RNAi agent is represented by formula (III):

sense: 5'$n_p$-$N_a$-(XXX)$_i$-$N_b$-YYY-$N_b$-(ZZZ)$_j$-$N_a$-$n_q$3'

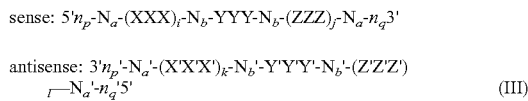
(III)

wherein: i, j, k, and l are each independently 0 or 1; p, p', q, and q' are each independently 0-6; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; each $n_p$, $n_p'$, $n_q$, and $n_q'$, each of which may or may not be present independently represents an overhang nucleotide; XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications; modifications on $N_b$ differ from the modification on Y and modifications on $N_b'$ differ from the modification on Y'; and wherein the sense strand is conjugated to at least one ligand.

In another aspect, the present invention provides a double stranded RNAi agent inhibiting expression of a sterol regulatory element binding protein (SREBP) chaperone (SCAP) gene in a cell, wherein the double stranded RNAi agent comprises a sense strand complementary to an antisense strand, wherein the antisense strand comprises a region complementary to part of an mRNA encoding SCAP, wherein each strand is about 14 to about 30 nucleotides in length, wherein the double stranded RNAi agent is represented by formula (III):

sense: 5'$n_p$-$N_a$-(XXX)$_i$-$N_b$-YYY-$N_b$-(ZZZ)$_j$-$N_a$-$n_q$3'

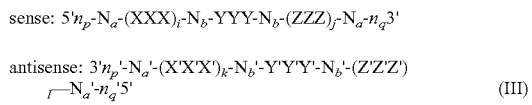
(III)

wherein: i, j, k, and l are each independently 0 or 1; each $n_p$, $n_q$, and $n_q'$, each of which may or may not be present, independently represents an overhang nucleotide; p, q, and q' are each independently 0-6; $n_p'$>0 and at least one $n_p'$ is linked to a neighboring nucleotide via a phosphorothioate linkage; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications; modifications on $N_b$ differ from the modification on Y and modifications on $N_b'$ differ from the modification on Y'; and wherein the sense strand is conjugated to at least one ligand.

In another aspect, the present invention provides a double stranded RNAi agent inhibiting expression of a sterol regulatory element binding protein (SREBP) chaperone (SCAP) gene in a cell, wherein the double stranded RNAi agent comprises a sense strand complementary to an antisense strand, wherein the antisense strand comprises a region complementary to part of an mRNA encoding SCAP, wherein each strand is about 14 to about 30 nucleotides in length, wherein the double stranded RNAi agent is represented by formula (III):

sense: 5'$n_p$-$N_a$-(XXX)$_i$-$N_b$-YYY-$N_b$-(ZZZ)$_j$-$N_a$-$n_q$3'

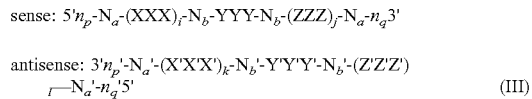
(III)

wherein: i, j, k, and l are each independently 0 or 1; each $n_p$, $n_q$, and $n_q'$, each of which may or may not be present, independently represents an overhang nucleotide; p, q, and q' are each independently 0-6; $n_p'$>0 and at least one $n_p'$ is linked to a neighboring nucleotide via a phosphorothioate linkage; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications; modifications on $N_b$ differ from the modification on Y and modifications on $N_b'$ differ from the modification on Y'; and wherein the sense strand is conjugated to at least one ligand, wherein the ligand is one or more GalNAc derivatives attached through a bivalent or trivalent branched linker.

In yet another aspect, the present invention provides a double stranded RNAi agent inhibiting expression of a sterol regulatory element binding protein (SREBP) chaperone (SCAP) gene in a cell, wherein the double stranded RNAi agent comprises a sense strand complementary to an antisense strand, wherein the antisense strand comprises a region complementary to part of an mRNA encoding SCAP, wherein each strand is about 14 to about 30 nucleotides in length, wherein the double stranded RNAi agent is represented by formula (III):

sense: 5'$n_p$-$N_a$-(XXX)$_i$-$N_b$-YYY-$N_b$-(ZZZ)$_j$-$N_a$-$n_q$3'

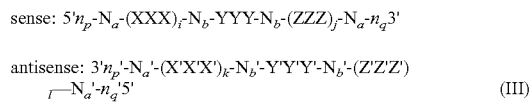
(III)

wherein: i, j, k, and l are each independently 0 or 1; each $n_p$, $n_q$, and $n_q'$, each of which may or may not be present, independently represents an overhang nucleotide; p, q, and q' are each independently 0-6; $n_p'$>0 and at least one $n_p'$ is linked to a neighboring nucleotide via a phosphorothioate linkage; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications; modifications on $N_b$ differ from the modification on Y and modifications on $N_b'$ differ from the modification on Y'; herein the sense strand comprises at least one phosphorothioate linkage; and wherein the sense strand is conjugated to at least one ligand, wherein the ligand is one or more GalNAc derivatives attached through a bivalent or trivalent branched linker.

In another aspect, the present invention provides a double stranded RNAi agent inhibiting expression of a sterol regulatory element binding protein (SREBP) chaperone (SCAP) gene in a cell, wherein the double stranded RNAi agent comprises a sense strand complementary to an antisense strand, wherein the antisense strand comprises a region complementary to part of an mRNA encoding SCAP, wherein each strand is about 14 to about 30 nucleotides in length, wherein the double stranded RNAi agent is represented by formula (III):

sense:5'$n_p$-$N_a$-YYY-$N_a$-$n_q$3' antisense: 3'$n_p'$-$N_a'$-Y'Y'Y'-$N_a'$-$n_q'$5'       (IIIa)

wherein: each $n_p$, $n_q$, and $n_q'$, each of which may or may not be present, independently represents an overhang nucleotide; p, q, and q' are each independently 0-6; $n_p'>0$ and at least one $n_p'$ is linked to a neighboring nucleotide via a phosphorothioate linkage; each $N_a$ and $N_a'$ independently represents an oligonucleotide sequence comprising 0-25 nucleotides which are either modified or unmodified or combinations thereof, each sequence comprising at least two differently modified nucleotides; YYY and Y'Y'Y' each independently represent one motif of three identical modifications on three consecutive nucleotides, and wherein the modifications are 2'-O-methyl or 2'-fluoro modifications; wherein the sense strand comprises at least one phosphorothioate linkage; and wherein the sense strand is conjugated to at least one ligand, wherein the ligand is one or more GalNAc derivatives attached through a bivalent or trivalent branched linker.

In yet another aspect, the present invention provides a double stranded ribonucleic acid (RNAi) agent for inhibiting expression of a sterol regulatory element binding protein (SREBP) chaperone (SCAP) gene, wherein the double stranded RNAi agent comprises a sense strand and an antisense strand forming a double stranded region, wherein the sense strand comprises at least 15 contiguous nucleotides differing by no more than 3 nucleotides from any one of the nucleotide sequences of SEQ ID NOs:1-13 and the antisense strand comprises at least 15 contiguous nucleotides differing by no more than 3 nucleotides from any one of the nucleotide sequences of SEQ ID NOs:14-26, wherein substantially all of the nucleotides of the sense strand comprise a modification selected from the group consisting of a 2'-O-methyl modification and a 2'-fluoro modification, wherein the sense strand comprises two phosphorothioate internucleotide linkages at the 5'-terminus, wherein substantially all of the nucleotides of the antisense strand comprise a modification selected from the group consisting of a 2'-O-methyl modification and a 2'-fluoro modification, wherein the antisense strand comprises two phosphorothioate internucleotide linkages at the 5'-terminus and two phosphorothioate internucleotide linkages at the 3'-terminus, and wherein the sense strand is conjugated to one or more GalNAc derivatives attached through a branched bivalent or trivalent linker at the 3'-terminus.

In another aspect, the present invention provides a double stranded ribonucleic acid (RNAi) agent for inhibiting expression of a sterol regulatory element binding protein (SREBP) chaperone (SCAP) gene, wherein the double stranded RNAi agent comprises a sense strand and an antisense strand forming a double stranded region, wherein the sense strand comprises at least 15 contiguous nucleotides differing by no more than 3 nucleotides from any one of the nucleotide sequences of SEQ ID NOs:1-13 and the antisense strand comprises at least 15 contiguous nucleotides differing by no more than 3 nucleotides from any one of the nucleotide sequences of SEQ ID NOs:14-26, wherein the sense strand comprises at least one 3'-terminal deoxy-thymine nucleotide (dT), and wherein the antisense strand comprises at least one 3'-terminal deoxy-thymine nucleotide (dT).

In another aspect, the invention provides cells containing the double stranded RNAi agents provided herein.

The invention also provides methods of inhibiting SCAP expression in a cell. The methods include contacting the cell with the double stranded RNAi agent or the pharmaceutical composition as described herein; and maintaining the cell for a time sufficient to obtain degradation of the mRNA transcript of a SCAP gene, thereby inhibiting expression of the SCAP gene in the cell.

In certain embodiments, the cell is within a subject. In certain embodiments, the subject is a human. In one embodiment, the subject is a female human. In another embodiment, the subject is a male human.

In certain embodiments, the human subject suffers from a SCAP-associated disease. In one embodiment, the SCAP-associated disease is nonalcoholic fatty liver disease (NAFLD). In another embodiment, the SCAP-associated disease is fatty liver (steatosis).

In another embodiment, the SCAP-associated disease is nonalcoholic steatohepatitis (NASH). In yet another embodiment, the SCAP-associated disease is obesity. In yet another embodiment, the SCAP-associated disease is insulin resistance.

In certain embodiments, the SCAP expression is inhibited by at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85% or at least about 90%.

In another aspect, the invention provides methods of treating a subject having a disorder that would benefit from reduction in SCAP expression. The methods include administering to the subject a therapeutically effective amount of any of the double stranded RNAi agents or the pharmaceutical composition provided herein, thereby treating the subject.

In certain embodiments, the human subject suffers from a SCAP-associated disease. In one embodiment, the SCAP-associated disease is nonalcoholic fatty liver disease (NAFLD). In another embodiment, the SCAP-associated disease is fatty liver (steatosis). In another embodiment, the SCAP-associated disease is nonalcoholic steatohepatitis (NASH). In yet another embodiment, the SCAP-associated disease is obesity. In yet another embodiment, the SCAP-associated disease is insulin resistance.

In certain embodiments, administration of the double stranded RNAi agent to the subject causes a decrease in one or more serum lipid, e.g., triglycerides, and/or a decrease in SCAP protein accumulation. In certain embodiments, the administration of the double stranded RNAi agent to the subject causes a decrease in PNPLA3 protein accumulation or SREBP protein accumulation.

In certain embodiments, the method of the present invention further comprises administering an additional therapeutic agent and/or treatment, e.g., life-style changes, e.g., exercise, weight loss, diet change, antioxidant therapy, intake of omega-3-fatty acids, and/or liver transplant.

In some embodiments, the double stranded RNAi agent is administered at a dose of about 0.01 mg/kg to about 50 mg/kg. In other embodiments, the double stranded RNAi agent is administered to the subject subcutaneously.

In a further aspect, the present invention also provides methods of inhibiting the expression of SCAP in a subject. The methods include administering to the subject a therapeutically effective amount of any of the double stranded RNAi agents or the pharmaceutical composition provided herein, thereby inhibiting the expression of SCAP in the subject.

In another aspect, the present invention provides methods of decreasing the plasma triglyceride level in a subject. The methods include administering to the subject a therapeutically effective amount of any of the double stranded RNAi agents or the pharmaceutical composition provided herein, thereby decreasing the plasma triglyceride level in the subject.

In another aspect, the present invention provides methods of inhibiting the progression of NAFLD in a subject, such as the progression of steatosis to NASH in a subject having steatosis or a subject at risk of developing steatosis, e.g., a subject having inusin resistance or an obese subject; or the progression of NASH to cirrhosis in a subject having NASH or a subject at risk of developing cirrhosis. The methods include administering to the subject a therapeutically effective amount of any of the double stranded RNAi agents or the pharmaceutical composition provided herein, thereby inhibiting the progeression of NAFLD in the subject.

In some embodiments, the methods of the invention may further include determining serum aspartate aminotransferase (AST) levels in the subject, alanine aminotransferase (ALT) levels in the subject, plasma triglyceride levels in the subject and/or determining the liver fat level in the subject In yet another aspect, the invention provides kits for performing the methods of the invention. In one embodiment, the invention provides a kit for performing a method of inhibiting expression of SCAP gene in a cell by contacting a cell with a double stranded RNAi agent of the invention in an amount effective to inhibit expression of the SCAP in the cell. The kit comprises an RNAi agent and instructions for use and, optionally, means for administering the RNAi agent to a subject.

DETAILED DESCRIPTION OF THE INVENTION

The present invention provides iRNA compositions, which effect the RNA-induced silencing complex (RISC)-mediated cleavage of RNA transcripts of a sterol regulatory element binding protein (SREBP) chaperone (SCAP) gene. The SCAP gene may be within a cell, e.g., a cell within a subject, such as a human. The present invention also provides methods of using the iRNA compositions of the invention for inhibiting the expression of a SCAP gene and/or for treating a subject having a disorder that would benefit from inhibiting or reducing the expression of a SCAP gene, e.g., a SCAP-associated disesase, for example, Nonalcoholic Fatty Liver Disease (NAFLD), e.g., nonalcoholic steatohepatitis (NASH).

The iRNAs of the invention include an RNA strand (the antisense strand) having a region which is about 30 nucleotides or less in length, e.g., 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of a SCAP gene.

In certain embodiments, the iRNAs of the invention include an RNA strand (the antisense strand) which can include longer lengths, for example up to 66 nucleotides, e.g., 36-66, 26-36, 25-36, 31-60, 22-43, 27-53 nucleotides in length with a region of at least 19 contiguous nucleotides that is substantially complementary to at least a part of an mRNA transcript of a C3 gene. These iRNAs with the longer length antisense strands preferably include a second RNA strand (the sense strand) of 20-60 nucleotides in length wherein the sense and antisense strands form a duplex of 18-30 contiguous nucleotides.

The use of these iRNAs enables the targeted degradation of mRNAs of a SCAP gene in mammals. Very low dosages of SCAP iRNAs, in particular, can specifically and efficiently mediate RNA interference (RNAi), resulting in significant inhibition of expression of a SCAP gene. Using cell-based assays, the present inventors have demonstrated that iRNAs targeting SCAP can mediate RNAi, resulting in significant inhibition of expression of a SCAP gene. Thus, methods and compositions including these iRNAs are useful for treating a subject who would benefit by a reduction in the levels and/or activity of a SCAP protein, such as a subject having a SCAP-associated disease, for example, Nonalcoholic Fatty Liver Disease (NAFLD), e.g., nonalcoholic steatohepatitis (NASH).

The following detailed description discloses how to make and use compositions containing iRNAs to inhibit the expression of a SCAP gene, as well as compositions and methods for treating subjects having diseases and disorders that would benefit from inhibition and/or reduction of the expression of this gene.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to". The term "or" is used herein to mean, and is used interchangeably with, the term "and/or," unless context clearly indicates otherwise.

The term "about" is used herein to mean within the typical ranges of tolerances in the art. For example, "about" can be understood as about 2 standard deviations from the mean. In certain embodiments, about means±10%. In certain embodiments, about means±5%. When about is present before a series of numbers or a range, it is understood that "about" can modify each of the numbers in the series or range.

The term "at least" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 18 nucleotides of a 21 nucleotide nucleic acid molecule" means that 18, 19, 20, or 21 nucleotides have the indicated property. When at least is present before a series of numbers or a range, it is understood that "at least" can modify each of the numbers in the series or range.

As used herein, "no more than" or "less than" is understood as the value adjacent to the phrase and logical lower values or intergers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range.

The term "SCAP" refers to sterol regulatory element binding protein (SREBP) chaperone, also known as SREBP cleavage activating protein, having an amino acid sequence from any vertebrate or mammalian source, including, but not limited to, human, bovine, chicken, rodent, mouse, rat, porcine, ovine, primate, monkey, and guinea pig, unless specified otherwise. The term also refers to fragments and variants of native SCAP that maintain at least one in vivo or in vitro activity of a native SCAP. The term encompasses full-length unprocessed precursor forms of SCAP as well as mature forms resulting from post-translational cleavage of the signal peptide. The nucleotide and amino acid sequence of a huma SCAP can be found at, for example, GenBank Accession No. GI: 66932901 (NM_012235.2; SEQ ID NO:1).

The nucleotide and amino acid sequence of a huma SCAP may also be found at, for example, GenBank Accession No. GI: 987996597 (NM_012235.3; SEQ ID NO:2); GenBank Accession No. GI: 530372097 (XM_005264967.1; SEQ ID NO:3); GenBank Accession No. GI: 530372099 (XM_005264968.1; SEQ ID NO:4); GenBank Accession No. GI: 530372101 (XM_005264969.1; SEQ ID NO:5); GenBank Accession No. GI: 767922691 (XM_011533501.1; SEQ ID NO:6); GenBank Accession No. GI: 767922693 (XM_011533502.1; SEQ ID NO:7); GenBank Accession No. GI: 767922696 (XM_005264970.3; SEQ ID NO:8); GenBank Accession No. GI: 530372105 (XM_005264971.1; SEQ ID NO:9); and GenBank Accession No. GI: 767922697 (XM_005264972.3; SEQ ID NO:10).

The nucleotide and amino acid sequence of a *Cynomolgus* monkey SCAP can be found at, for example, GenBank Accession No. GI: 544413972 (XM_005546963.1; SEQ ID NO:11). The nucleotide and amino acid sequence of a mouse SCAP can be found at, for example, GenBank Accession No. GI: 557636668 (NM_001103162.2; SEQ ID NO:12). The nucleotide and amino acid sequence of a rat SCAP can be found at, for example, GenBank Accession No. GI: 155369286 (NM_001100966.1; SEQ ID NO:13). Additional examples of SCAP sequences are readily available using publicly available databases, e.g., GenBank, UniProt, and OMIM.

The term"SCAP" as used herein also refers to a particular polypeptide expressed in a cell by naturally occurring DNA sequence variations of the SCAP gene, such as a single nucleotide polymorphism in the SCAP gene. Numerous SNPs within the SCAP gene have been identified and may be found at, for example, NCBI dbSNP (see, e.g., www.ncbi.nlm.nih.gov/snp). Non-limiting examples of SNPs within the SCAP gene may be found at, NCBI dbSNP Accession Nos. rs926103; rs12487736; rs12490383; rs754498; rs877097; rs878659; rs881264; rs900690; rs900691; rs900692; rs909200; rs909201; rs928391; or rs943555.

As used herein, "target sequence" refers to a contiguous portion of the nucleotide sequence of an mRNA molecule formed during the transcription of a SCAP gene, including mRNA that is a product of RNA processing of a primary transcription product. In one embodiment, the target portion of the sequence will be at least long enough to serve as a substrate for iRNA-directed cleavage at or near that portion of the nucleotide sequence of an mRNA molecule formed during the transcription of a SCAP gene.

The target sequence may be from about 9-36 nucleotides in length, e.g., about 15-30 nucleotides in length. For example, the target sequence can be from about 15-30 nucleotides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

As used herein, the term "strand comprising a sequence" refers to an oligonucleotide comprising a chain of nucleotides that is described by the sequence referred to using the standard nucleotide nomenclature.

"G," "C," "A," "T" and "U" each generally stand for a nucleotide that contains guanine, cytosine, adenine, thymidine and uracil as a base, respectively. However, it will be understood that the term "ribonucleotide" or "nucleotide" can also refer to a modified nucleotide, as further detailed below, or a surrogate replacement moiety (see, e.g., Table 1). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA", "RNAi agent," "iRNA agent," "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of SCAP in a cell, e.g., a cell within a subject, such as a mammalian subject.

In one embodiment, an RNAi agent of the invention includes a single stranded RNAi that interacts with a target RNA sequence, e.g., an SCAP target mRNA sequence, to direct the cleavage of the target RNA. Without wishing to be bound by theory it is believed that long double stranded RNA introduced into cells is broken down into double-stranded short interfering RNAs (siRNAs) comprising a sense strand and an antisense strand by a Type III endonuclease known as Dicer (Sharp et al. (2001) *Genes Dev.* 15:485). Dicer, a ribonuclease-III-like enzyme, processes these dsRNA into 19-23 base pair short interfering RNAs with characteristic two base 3' overhangs (Bernstein, et al., (2001) *Nature* 409:363). These siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (ssRNA) (the antisense strand of an siRNA duplex) generated within a cell and which promotes the formation of a RISC complex to effect silencing of the target gene, i.e., an SCAP gene. Accordingly, the term "siRNA" is also used herein to refer to an RNAi as described above.

In another embodiment, the RNAi agent may be a single-stranded RNA that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded RNAs are described in U.S. Pat. No. 8,101,348 and in Lima et al., (2012) *Cell* 150:883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In another embodiment, an "IRNA" for use in the compositions and methods of the invention is a double stranded RNA and is referred to herein as a "double stranded RNAi agent," "double stranded RNA (dsRNA) molecule," "dsRNA agent," or "dsRNA". The term "dsRNA" refers to a complex of ribonucleic acid molecules, having a duplex structure comprising two anti-parallel and substantially complementary nucleic acid strands, referred to as having "sense" and "antisense" orientations with respect to a target RNA, i.e., a SCAP gene. In some embodiments of the invention, a double stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide and/or a modified nucleotide. In addition, as used in this specification, an "RNAi agent" may include ribonucleotides with chemical modifications; an RNAi agent may include substantial modifications at multiple nucleotides. As used herein, the term "modified nucleotide" refers to a nucleotide having, independently, a modified sugar moiety, a modified internucleotide linkage, and/or a modified nucleobase. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "RNAi agent" for the purposes of this specification and claims.

The duplex region may be of any length that permits specific degradation of a desired target RNA through a RISC pathway, and may range from about 9 to 36 base pairs in length, e.g., about 15-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, at least 3, at least 4, at least 5, at least 6, at least 7, at least 8, at least 9, at least 10, at least 20, at least 23 or more unpaired nucleotides. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

Where the two substantially complementary strands of a dsRNA are comprised by separate RNA molecules, those molecules need not, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs. In one embodiment of the RNAi agent, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In one embodiment, an RNAi agent of the invention is a dsRNA, each strand of which comprises 19-23 nucleotides, that interacts with a target RNA sequence, e.g., a SCAP target mRNA sequence, to direct the cleavage of the target RNA. Without wishing to be bound by theory, long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107: 309). Upon binding to the appropriate target mRNA, one or more endonucleases within the RISC cleave the target to induce silencing (Elbashir, et al., (2001) *Genes Dev.* 15:188).

As used herein, the term "nucleotide overhang" refers to at least one unpaired nucleotide that protrudes from the duplex structure of an iRNA, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

In one embodiment, the antisense strand of a dsRNA has a 1-10 nucleotide, e.g., a 1, 2, 3, 4, 5, 6, 7, 8, 9, or 10 nucleotide, overhang at the 3'-end and/or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end and/or the 5'-end. In another embodiment, one or more of the nucleotides in the overhang is replaced with a nucleoside thiophosphate.

In certain embodiments, the antisense strand of a dsRNA has a 1-10 nucleotide, e.g., 0-3, 1-3, 2-4, 2-5, 4-10, 5-10, e.g., a 1, 2, 3, 4, 5, 6, 7, 8, 9, or 10 nucleotide, overhang at the 3'-end and/or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end and/or the 5'-end. In another embodiment, one or more of the nucleotides in the overhang is replaced with a nucleoside thiophosphate.

In certain embodiments, the overhang on the sense strand or the antisense strand, or both, can include extended lengths longer than 10 nucleotides, e.g., 1-30 nucleotides, 2-30 nucleotides, 10-30 nucleotides, or 10-15 nucleotides in length. In certain embodiments, an extended overhang is on the sense strand of the duplex. In certain embodiments, an extended overhang is present on the 3'end of the sense strand of the duplex. In certain embodiments, an extended overhang is present on the 5'end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the overhang is replaced with a nucleoside thiophosphate. In certain embodiments, the overhang includes a self-complementary portion such that the overhang is capable of forming a hairpin structure that is stable under physiological conditions.

The terms "blunt" or "blunt ended" as used herein in reference to a dsRNA mean that there are no unpaired nucleotides or nucleotide analogs at a given terminal end of a dsRNA, i.e., no nucleotide overhang. One or both ends of a dsRNA can be blunt. Where both ends of a dsRNA are blunt, the dsRNA is said to be blunt ended. To be clear, a "blunt ended" dsRNA is a dsRNA that is blunt at both ends, i.e., no nucleotide overhang at either end of the molecule. Most often such a molecule will be double stranded over its entire length.

The term "antisense strand" or "guide strand" refers to the strand of an iRNA, e.g., a dsRNA, which includes a region that is substantially complementary to a target sequence, e.g., a SCAP mRNA.

As used herein, the term "region of complementarity" refers to the region on the antisense strand that is substantially complementary to a sequence, for example a target sequence, e.g., a SCAP nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, 3, or 2 nucleotides of the 5'- and/or 3'-terminus of the iRNA.

The term "sense strand" or "passenger strand" as used herein, refers to the strand of an iRNA that includes a region that is substantially complementary to a region of the antisense strand as that term is defined herein.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs and/or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially complementary" herein can be used with respect to the base matching between the sense strand and the antisense strand of a dsRNA, or between the antisense strand of an iRNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding SCAP). For example, a polynucleotide is complementary to at least a part of a SCAP mRNA if the sequence is substantially complementary to a non-interrupted portion of an mRNA encoding SCAP.

Accordingly, in some embodiments, the antisense strand polynucleotides disclosed herein are fully complementary to the target SCAP sequence. In other embodiments, the antisense strand polynucleotides disclosed herein are substantially complementary to the target SCAP sequence and comprise a contiguous nucleotide sequence which is at least about 80% complementary over its entire length to the equivalent region of the nucleotide sequence of SEQ ID NOs:1-13, or a fragment of SEQ ID NOs:1-13, such as about 85%, about 86%, about 87%, about 88%, about 89%, about 90%, about % 91%, about 92%, about 93%, about 94%, about 95%, about 96%, about 97%, about 98%, or about 99% complementary.

In other embodiments, the antisense polynucleotides disclosed herein are substantially complementary to the target SCAP sequence and comprise a contiguous nucleotide sequence which is at least about 80% complementary over its entire length to any one of the sense strand nucleotide sequences in any one of Tables 2, 3, 5, or 6, or a fragment of any one of the sense strand nucleotide sequences in any one of Tables 2, 3, 5, or 6, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, an RNAi agent of the invention includes a sense strand that is substantially complementary to an antisense polynucleotide which, in turn, is the same as a target SCAP sequence, and wherein the sense strand polynucleotide comprises a contiguous nucleotide sequence which is at least about 80% complementary over its entire length to the equivalent region of the nucleotide sequence of SEQ ID NOs:14-26, or a fragment of any one of SEQ ID NOs:14-26, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, at least partial suppression of the expression of a SCAP gene, is assessed by a reduction of the amount of SCAP mRNA which can be isolated from or detected in a first cell or group of cells in which a SCAP gene is transcribed and which has or have been treated such that the expression of a SCAP gene is inhibited, as compared to a second cell or group of cells substantially identical to the first cell or group of cells but which has or have not been so treated (control cells). The degree of inhibition may be expressed in terms of:

$$\frac{(mRNA \text{ in control cells}) - (mRNA \text{ in treated cells})}{(mRNA \text{ in control cells})} \cdot 100\%$$

The phrase "contacting a cell with an RNAi agent," such as a dsRNA, as used herein, includes contacting a cell by any possible means. Contacting a cell with an RNAi agent includes contacting a cell in vitro with the iRNA or contacting a cell in vivo with the iRNA. The contacting may be done directly or indirectly. Thus, for example, the RNAi agent may be put into physical contact with the cell by the individual performing the method, or alternatively, the RNAi agent may be put into a situation that will permit or cause it to subsequently come into contact with the cell.

Contacting a cell in vitro may be done, for example, by incubating the cell with the RNAi agent. Contacting a cell in vivo may be done, for example, by injecting the RNAi agent into or near the tissue where the cell is located, or by injecting the RNAi agent into another area, e.g., the bloodstream or the subcutaneous space, such that the agent will subsequently reach the tissue where the cell to be contacted is located. For example, the RNAi agent may contain and/or be coupled to a ligand, e.g., GalNAc3, that directs the RNAi agent to a site of interest, e.g., the liver. Combinations of in vitro and in vivo methods of contacting are also possible. For example, a cell may also be contacted in vitro with an RNAi agent and subsequently transplanted into a subject.

In one embodiment, contacting a cell with an iRNA includes "introducing" or "delivering the iRNA into the cell" by facilitating or effecting uptake or absorption into the cell. Absorption or uptake of an iRNA can occur through unaided diffusive or active cellular processes, or by auxiliary agents or devices. Introducing an iRNA into a cell may be in vitro and/or in vivo. For example, for in vivo introduction, iRNA can be injected into a tissue site or administered systemically. In vitro introduction into a cell includes methods known in the art such as electroporation and lipofection. Further approaches are described herein below and/or are known in the art.

The term "lipid nanoparticle" or "LNP" is a vesicle comprising a lipid layer encapsulating a pharmaceutically active molecule, such as a nucleic acid molecule, e.g., an iRNA or a plasmid from which an iRNA is transcribed. LNPs are described in, for example, U.S. Pat. Nos. 6,858,225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), a non-primate (such as a cow, a pig, a camel, a llama, a horse, a goat, a rabbit, a sheep, a hamster, a guinea pig, a cat, a dog, a rat, a mouse, a horse, and a whale), or a bird (e.g., a duck or a goose). In an embodiment, the subject is a human, such as a human being treated or assessed for a disease, disorder or condition that would benefit from reduction in SCAP expression; a human at risk for a disease, disorder or condition that would benefit from reduction in SCAP expression; a human having a disease, disorder or condition that would benefit from reduction in SCAP expression; and/or human being treated for a disease, disorder or condition that would benefit from reduction in SCAP expression as described herein.

As used herein, the terms "treating" or "treatment" refer to a beneficial or desired result including, but not limited to, alleviation or amelioration of one or more symptoms associated with SCAP gene expression and/or SCAP protein production, e.g., fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD). "Treatment" can also mean prolonging survival as compared to expected survival in the absence of treatment.

The term "lower" in the context of the level of SCAP in a subject or a disease marker or symptom refers to a statistically significant decrease in such level. The decrease can be, for example, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more. In certain embodiments, a decrease is at least 20%. "Lower" in the context of the level of SCAP in a subject is preferably down to a level accepted as within the range of normal for an individual without such disorder.

As used herein, "prevention" or "preventing," when used in reference to a disease, disorder or condition thereof, that would benefit from a reduction in expression of a SCAP gene and/or production of SCAP protein, refers to a reduction in the likelihood that a subject will develop a symptom associated with such a disease, disorder, or condition, e.g., a symptom of SCAP gene expression, such as the presence of fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD). The failure to develop a disease, disorder or condition, or the reduction in the development of a symptom associated with such a disease, disorder or condition (e.g., by at least about 10% on a clinically accepted scale for that disease or disorder), or the exhibition of delayed symptoms delayed (e.g., by days, weeks, months or years) is considered effective prevention.

As used herein, the term "SCAP-associated disease," is a disease or disorder that is caused by, or associated with SCAP gene expression or SCAP protein production. The term "SCAP-associated disease" includes a disease, disorder or condition that would benefit from a decrease in SCAP gene expression, replication, or protein activity. Non-limiting examples of SCAP-associated diseases include, for example, fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD), hyperlipidemia, hyperlipoproteinemia, hypercholesterolemis, hypertriglyceridemia, atherosclerosis, pancreatitis, non-insulin dependent diatebes mellitus, coronary heart disease, and cerebrovascular disease. In one embodiment, the SCAP-associated disease is nonalcoholic fatty liver disease (NAFLD). In another embodiment, the SCAP-associated disease is nonalcoholic steatohepatitis (NASH). In another embodiment, the SCAP-associated disease is liver cirrhosis. In another embodiment, the SCAP-associated disease is insulin resistance. In another embodiment, the SCAP-associated disease is not insulin resistance. In one embodiment, the SCAP-associated disease is obesity.

In one embodiment, a SCAP-associated disease is nonalcoholic fatty liver disease (NAFLD). As used herein, "nonalcoholic fatty liver disease," used interchangeably with the term "NAFLD," refers to a disease defined by the presence of macrovascular steatosis in the presence of less than 20 gm of alcohol ingestion per day. NAFLD is the most common liver disease in the United States, and is commonly associated with insulin resistance/type 2 diabetes mellitus and obesity. NAFLD is manifested by steatosis, steatohepatitis, cirrhosis, and sometimes hepatocellaular carcinoma. For a review of NAFLD, see Tolman and Dalpiaz (2007) *Ther. Clin. Risk. Manag.*, 3(6):1153-1163 the entire contents of which are incorporated herein by reference.

As used herein, the terms "steatosis," "hepatic steatosis," and "fatty liver disease" refer to the accumulation of triglycerides and other fats in the liver cells.

As used herein, ther term "Nonalcoholic steatohepatitis" or "NASH" refers to liver inflammation and damage caused by a buildup of fat in the liver. NASH is part of a group of conditions called nonalcoholic fatty liver disease (NAFLD). NASH resembles alcoholic liver disease, but occurs in people who drink little or no alcohol. The major feature in NASH is fat in the liver, along with inflammation and damage. Most people with NASH feel well and are not aware that they have a liver problem. Nevertheless, NASH can be severe and can lead to cirrhosis, in which the liver is permanently damaged and scarred and no longer able to work properly. NASH is usually first suspected in a person who is found to have elevations in liver tests that are included in routine blood test panels, such as alanine aminotransferase (ALT) or aspartate aminotransferase (AST). When further evaluation shows no apparent reason for liver disease (such as medications, viral hepatitis, or excessive use of alcohol) and when x rays or imaging studies of the liver show fat, NASH is suspected. The only means of proving a diagnosis of NASH and separating it from simple fatty liver is a liver biopsy.

As used herein, the term "cirrhosis," defined histologically, is a diffuse hepatic process characterized by fibrosis and conversion of the normal liver architecture into structurally abnormal nodules.

As used herein, the term "serum lipid" refers to any major lipid present in the blood. Serum lipids may be present in the blood either in free form or as a part of a protein complex, e.g., a lipoprotein complex. Non-limiting examples of serum lipids may include triglycerides (TG), cholesterol, such as total cholesterol (TC), low density lipoprotein cholesterol (LDL-C), high-density lipoprotein cholesterol (HDL-C), very low density lipoprotein cholesterol (VLDL-C) and intermediate-density lipoprotein cholesterol (IDL-C).

"Therapeutically effective amount," as used herein, is intended to include the amount of an RNAi agent that, when administered to a subject having a SCAP-associated disorder, is sufficient to effect treatment of the disease (e.g., by diminishing, ameliorating or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of an iRNA that, when administered to a subject having a SCAP-associated disorder, is sufficient to prevent or ameliorate the disease or one or more symptoms of the disease. Ameliorating the disease includes slowing the course of the disease or reducing the severity of later-developing disease. The "prophylactically effective amount" may vary depending on the iRNA, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylacticaly effective amount" also includes an amount of an RNAi agent that produces some desired local or systemic effect at a reasonable benefit/risk ratio applicable to any treatment. iRNA employed in the methods of the present invention may be administered in a sufficient amount to produce a reasonable benefit/risk ratio applicable to such treatment.

The phrase "pharmaceutically acceptable" is employed herein to refer to those compounds, materials, compositions, and/or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; and (22) other non-toxic compatible substances employed in pharmaceutical formulations.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). In some embodiments, a "sample derived from a subject" refers to blood or plasma drawn from the subject. In further embodiments, a "sample derived from a subject" refers to liver tissue (or subcomponents thereof) or retinal tissue (or subcomponents thereof) derived from the subject.

II. iRNAs of the Invention

Described herein are iRNAs which inhibit the expression of a SCAP gene. In one embodiment, the iRNA agent includes double stranded ribonucleic acid (dsRNA) molecules for inhibiting the expression of a SCAP gene in a cell, such as a cell within a subject, e.g., a mammal, such as a human having a SCAP-associated disorder, e.g., nonalcoholic fatty liver disease (NAFLD) or nonalcoholic steatohepatitis (NASH). The dsRNA includes an antisense strand having a region of complementarity which is complementary to at least a part of an mRNA formed in the expression of a SCAP gene, The region of complementarity is about 30 nucleotides or less in length (e.g., about 30, 29, 28, 27, 26, 25, 24, 23, 22, 21, 20, 19, or 18 nucleotides or less in length). Upon contact with a cell expressing the SCAP gene, the iRNA inhibits the expression of the SCAP gene (e.g., a human, a primate, a non-primate, or a bird SCAP gene) by at least about 10% as assayed by, for example, a PCR or branched DNA (bDNA)-based method, or by a protein-based method, such as by immunofluorescence analysis, using, for example, Western Blotting or flowcytometric techniques.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of a SCAP gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is between 15 and 30 base pairs in length, e.g., between, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

Similarly, the region of complementarity to the target sequence is between 15 and 30 nucleotides in length, e.g., between 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

In some embodiments, the dsRNA is between about 15 and about 23 nucleotides in length, or between about 25 and about 30 nucleotides in length. In general, the dsRNA is long enough to serve as a substrate for the Dicer enzyme. For example, it is well known in the art that dsRNAs longer than about 21-23 nucleotides can serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 9 to 36 base pairs, e.g., about 10-36, 11-36, 12-36, 13-36, 14-36, 15-36, 9-35, 10-35, 11-35, 12-35, 13-35, 14-35, 15-35, 9-34, 10-34, 11-34, 12-34, 13-34, 14-34, 15-34, 9-33, 10-33, 11-33, 12-33, 13-33, 14-33, 15-33, 9-32, 10-32, 11-32, 12-32, 13-32, 14-32, 15-32, 9-31, 10-31, 11-31, 12-31, 13-32, 14-31, 15-31, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target SCAP expression is not generated in the target cell by cleavage of a larger dsRNA.

A dsRNA as described herein can further include one or more single-stranded nucleotide overhangs e.g., 1, 2, 3, or 4 nucleotides. dsRNAs having at least one nucleotide overhang can have unexpectedly superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

A dsRNA can be synthesized by standard methods known in the art as further discussed below, e.g., by use of an automated DNA synthesizer, such as are commercially available from, for example, Biosearch, Applied Biosystems, Inc.

iRNA compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Single-stranded oligonucleotides of the invention can be prepared using solution-phase or solid-phase organic synthesis or both.

In one aspect, a dsRNA of the invention includes at least two nucleotide sequences, a sense sequence and an antisense sequence. The sense strand sequence may be selected from the group of sequences provided in any one of Tables 2, 3, 5 and 6, and the corresponding nucleotide sequence of the antisense strand of the sense strand may be selected from the group of sequences of any one of Tables 2, 3, 5 and 6. In this aspect, one of the two sequences is complementary to the other of the two sequences, with one of the sequences being substantially complementary to a sequence of an mRNA generated in the expression of a SCAP gene. As such, in this aspect, a dsRNA will include two oligonucleotides, where one oligonucleotide is described as the sense strand (passenger strand) in any one of Tables 2, 3, 5 and 6, and the second oligonucleotide is described as the corresponding antisense strand (guide strand) of the sense strand in any one of Tables 2, 3, 5 and 6. In one embodiment, the substantially complementary sequences of the dsRNA are contained on separate oligonucleotides. In another embodiment, the substantially complementary sequences of the dsRNA are contained on a single oligonucleotide.

It will be understood that, although the sequences in Tables 2, 3, 5 and 6 are described as modified and/or conjugated sequences, the RNA of the iRNA of the invention e.g., a dsRNA of the invention, may comprise any one of the sequences set forth in any one of Tables 2, 3, 5 and 6 that is un-modified, un-conjugated, and/or modified and/or conjugated differently than described therein.

The skilled person is well aware that dsRNAs having a duplex structure of between about 20 and 23 base pairs, e.g., 21, base pairs have been hailed as particularly effective in inducing RNA interference (Elbashir et al., (2001) *EMBO J.*, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided herein, dsRNAs described herein can include at least one strand of a length of minimally 21 nucleotides. It can be reasonably expected that shorter duplexes minus only a few nucleotides on one or both ends can be similarly effective as compared to the dsRNAs described above. Hence, dsRNAs having a sequence of at least 15, 16, 17, 18, 19, 20, or more contiguous nucleotides derived from one of the sequences provided herein, and differing in their ability to inhibit the expression of a SCAP gene by not more than about 5, 10, 15, 20, 25, or 30% inhibition from a dsRNA comprising the full sequence, are contemplated to be within the scope of the present invention.

In addition, the RNAs described herein identify a site(s) in a SCAP transcript that is susceptible to RISC-mediated cleavage. As such, the present invention further features iRNAs that target within this site(s). As used herein, an iRNA is said to target within a particular site of an RNA transcript if the iRNA promotes cleavage of the transcript anywhere within that particular site. Such an iRNA will generally include at least about 15 contiguous nucleotides from one of the sequences provided herein coupled to additional nucleotide sequences taken from the region contiguous to the selected sequence in a SCAP gene.

While a target sequence is generally about 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that can serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays as described herein or as known in the art) to identify those sequences that perform optimally can identify those RNA sequences that, when targeted with an iRNA agent, mediate the best inhibition of target gene expression. Thus, while the sequences identified herein represent effective target sequences, it is contemplated that further optimization of inhibition efficiency can be achieved by progressively "walking the window" one nucleotide upstream or downstream of the given sequences to identify sequences with equal or better inhibition characteristics.

Further, it is contemplated that for any sequence identified herein, further optimization could be achieved by systematically either adding or removing nucleotides to generate longer or shorter sequences and testing those sequences generated by walking a window of the longer or shorter size up or down the target RNA from that point. Again, coupling this approach to generating new candidate targets with testing for effectiveness of iRNAs based on those target sequences in an inhibition assay as known in the art and/or as described herein can lead to further improvements in the efficiency of inhibition. Further still, such optimized sequences can be adjusted by, e.g., the introduction of modified nucleotides as described herein or as known in the art, addition or changes in overhang, or other modifications as known in the art and/or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes) as an expression inhibitor.

An iRNA agent as described herein can contain one or more mismatches to the target sequence. In one embodiment, an iRNA as described herein contains no more than 3 mismatches. If the antisense strand of the iRNA contains mismatches to a target sequence, it is preferable that the area of mismatch is not located in the center of the region of complementarity. If the antisense strand of the iRNA contains mismatches to the target sequence, it is preferable that the mismatch be restricted to be within the last 5 nucleotides from either the 5'- or 3'-end of the region of complementarity. For example, for a 23 nucleotide iRNA agent the strand which is complementary to a region of a SCAP gene, generally does not contain any mismatch within the central 13 nucleotides. The methods described herein or methods known in the art can be used to determine whether an iRNA containing a mismatch to a target sequence is effective in inhibiting the expression of a SCAP gene. Consideration of the efficacy of iRNAs with mismatches in inhibiting expression of a SCAP gene is important, especially if the particular region of complementarity in a SCAP gene is known to have polymorphic sequence variation within the population.

III. Modified iRNAs of the Invention

In one embodiment, the RNA of the iRNA of the invention e.g., a dsRNA, is un-modified, and does not comprise, e.g., chemical modifications and/or conjugations known in the art and described herein. In another embodiment, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA of the invention are modified. iRNAs of the invention in which "substantially all of the nucleotides are modified" are largely but not wholly modified and can include not more than 5, 4, 3, 2, or 1 unmodified nucleotides. In still other embodiments of the invention, iRNAs of the invention can include not more than 5, 4, 3, 2 or 1 modified nucleotides.

The nucleic acids featured in the invention can be synthesized and/or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; and/or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519, 126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the entire contents of each of which are hereby incorporated herein by reference.

In other embodiments, suitable RNA mimetics are contemplated for use in iRNAs, in which both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., Science, 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$—[known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$—[wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The iRNAs, e.g., dsRNAs, featured herein can include one of the following at the 2'-position: OH; F; O—, S—, or N-alkyl; O—, S—, or N-alkenyl; O—, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)_nOCH_3$, $O(CH_2)_n$—$NH_2$, $O(CH_2)_nCH_3$, $O(CH_2)_n$—$ONH_2$, and $O(CH_2)_n$—$ON[(CH_2).CH_3]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., Helv. Chin. Acta, 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—N($CH_2$)$_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-$OCH_3$), 2'-aminopropoxy (2'-$OCH_2CH_2CH_2NH_2$) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA of the invention can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. I., ed. John Wiley & Sons, 1990, these disclosed by Englisch et al., (1991) *Angewandte Chemie, International Edition,* 30:613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130, 30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

An iRNA of the invention can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193).

An iRNA of the invention can also be modified to include one or more bicyclic sugar moieties. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH2-O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193).

Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge. Examples of such 4' to 2' bridged bicyclic nucleosides, include but are not limited to 4'-(CH2)-O-2' (LNA); 4'-(CH2)-S-2'; 4'-(CH2)2-O-2' (ENA); 4'-CH(CH3)-O-2' (also referred to as "constrained ethyl" or "cEt") and 4'-CH(CH2OCH3)-O-2' (and analogs thereof; see, e.g., U.S. Pat. No. 7,399,845); 4'-C(CH3)(CH3)-O-2' (and analogs thereof; see e.g., U.S. Pat. No. 8,278,283); 4'-CH2-N(OCH3)-2' (and analogs thereof; see e.g., U.S. Pat. No. 8,278,425); 4'-CH2-O—N(CH3)-2' (see, e.g., U.S. Patent Publication No. 2004/0171570); 4'-CH2-N(R)—O-2', wherein R is H, C1-C12 alkyl, or a protecting group (see, e.g., U.S. Pat. No. 7,427,672); 4'-CH2-C(H)(CH3)-2' (see, e.g., Chattopadhyaya et al., *J. Org. Chem.,* 2009, 74, 118-134); and 4'-CH2-C(=CH2)-2' (and analogs thereof; see, e.g., U.S. Pat. No. 8,278,426). The entire contents of each of the foregoing are hereby incorporated herein by reference.

Additional representative U.S. Patents and US Patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

An iRNA of the invention can also be modified to include one or more constrained ethyl nucleotides. As used herein, a "constrained ethyl nucleotide" or "cEt" is a locked nucleic acid comprising a bicyclic sugar moiety comprising a 4'-CH(CH3)-O-2' bridge. In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US Patent Publication No. 2013/0190383; and PCT publication WO 2013/036868, the entire contents of each of which are hereby incorporated herein by reference.

In some embodiments, an iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series,* 52, 133-134 (2008) and Fluiter et al., *Mol. Biosyst.*, 2009, 10, 1039 hereby incorporated by reference).

Representative U.S. publications that teach the preparation of UNA include, but are not limited to, U.S. Pat. No. 8,314,227; and US Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

Other modifications of an iRNA of the invention include a 5' phosphate or 5' phosphate mimic, e.g., a 5'-terminal phosphate or phosphate mimic on the antisense strand of an RNAi agent. Suitable phosphate mimics are disclosed in, for example US Patent Publication No. 2012/0157511, the entire contents of which are incorporated herein by reference.

A. Modified iRNAs Comprising Motifs of the Invention

In certain aspects of the invention, the double-stranded RNAi agents of the invention include agents with chemical modifications as disclosed, for example, in WO 2013/075035, filed on Nov. 16, 2012, the entire contents of which are incorporated herein by reference. As shown herein and in PCT Publication No. WO 2013/075035, a superior result may be obtained by introducing one or more motifs of three identical modifications on three consecutive nucleotides into a sense strand and/or antisense strand of an RNAi agent, particularly at or near the cleavage site. In some embodiments, the sense strand and antisense strand of the RNAi agent may otherwise be completely modified. The introduction of these motifs interrupts the modification pattern, if present, of the sense and/or antisense strand. The RNAi agent may be optionally conjugated with a GalNAc derivative ligand, for instance on the sense strand. The resulting RNAi agents present superior gene silencing activity.

More specifically, it has been surprisingly discovered that when the sense strand and antisense strand of the double-stranded RNAi agent are completely modified to have one or more motifs of three identical modifications on three consecutive nucleotides at or near the cleavage site of at least one strand of an RNAi agent, the gene silencing acitivity of the RNAi agent was superiorly enhanced.

Accordingly, the invention provides double stranded RNAi agents capable of inhibiting the expression of a target gene (i.e., a SCAP gene) in vivo. The RNAi agent comprises a sense strand and an antisense strand. Each strand of the RNAi agent may range from 12-30 nucleotides in length. For example, each strand may be between 14-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as an "RNAi agent." The duplex region of an RNAi agent may be 12-30 nucleotide pairs in length. For example, the duplex region can be between 14-30 nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27 nucleotides in length.

In one embodiment, the RNAi agent may contain one or more overhang regions and/or capping groups at the 3'-end, 5'-end, or both ends of one or both strands. The overhang can be 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In one embodiment, the nucleotides in the overhang region of the RNAi agent can each independently be a modified or unmodified nucleotide including, but no limited to 2'-sugar modified, such as, 2-F, 2'-Omethyl, thymidine (T), and any combinations thereof. For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand or both strands of the RNAi agent may be phosphorylated. In some embodiments, the overhang region(s) contains two nucleotides having a phosphorothioate between the two nucleotides, where the two nucleotides can be the same or different. In one embodiment, the overhang is present at the 3'-end of the sense strand, antisense strand, or both strands. In one embodiment, this 3'-overhang is present in the antisense strand. In one embodiment, this 3'-overhang is present in the sense strand.

The RNAi agent may contain only a single overhang, which can strengthen the interference activity of the RNAi, without affecting its overall stability. For example, the single-stranded overhang may be located at the 3'-terminal end of the sense strand or, alternatively, at the 3'-terminal end of the antisense strand. The RNAi may also have a blunt end, located at the 5'-end of the antisense strand (or the 3'-end of the sense strand) or vice versa. Generally, the antisense strand of the RNAi has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In one embodiment, the RNAi agent is a double ended bluntmer of 19 nucleotides in length, wherein the sense strand contains at least one motif of three 2'-F modifications on three consecutive nucleotides at positions 7, 8, 9 from the 5'end. The antisense strand contains at least one motif of three 2'-O-methyl modifications on three consecutive nucleotides at positions 11, 12, 13 from the 5'end.

In another embodiment, the RNAi agent is a double ended bluntmer of 20 nucleotides in length, wherein the sense strand contains at least one motif of three 2'-F modifications on three consecutive nucleotides at positions 8, 9, 10 from the 5'end. The antisense strand contains at least one motif of three 2'-O-methyl modifications on three consecutive nucleotides at positions 11, 12, 13 from the 5'end.

In yet another embodiment, the RNAi agent is a double ended bluntmer of 21 nucleotides in length, wherein the sense strand contains at least one motif of three 2'-F modifications on three consecutive nucleotides at positions 9, 10, 11 from the 5'end. The antisense strand contains at least one motif of three 2'-O-methyl modifications on three consecutive nucleotides at positions 11, 12, 13 from the 5'end.

In one embodiment, the RNAi agent comprises a 21 nucleotide sense strand and a 23 nucleotide antisense strand, wherein the sense strand contains at least one motif of three 2'-F modifications on three consecutive nucleotides at positions 9, 10, 11 from the 5'end; the antisense strand contains at least one motif of three 2'-O-methyl modifications on three consecutive nucleotides at positions 11, 12, 13 from the 5'end, wherein one end of the RNAi agent is blunt, while the other end comprises a 2 nucleotide overhang. Preferably, the 2 nucleotide overhang is at the 3'-end of the antisense strand. When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In one embodiment, every nucleotide in the sense strand and the antisense strand of the RNAi agent, including the nucleotides that are part of the motifs are modified nucleotides. In one embodiment each residue is independently modified with a 2'-O-methyl or 3'-fluoro, e.g., in an alternating motif. Optionally, the RNAi agent further comprises a ligand (preferably GalNAc$_3$).

In one embodiment, the RNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3 ' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In one embodiment, the RNAi agent comprises sense and antisense strands, wherein the RNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1-4 nucleotides longer at its 3' end than the first strand, wherein the duplex region region which is at least 25 nucleotides in length, and the second strand is sufficiently complemenatary to a target mRNA along at least 19 nucleotide of the second strand length to reduce target gene expression when the RNAi agent is introduced into a mammalian cell, and wherein dicer cleavage of the RNAi agent preferentially results in an siRNA comprising the 3' end of the second strand, thereby reducing expression of the target gene in the mammal. Optionally, the RNAi agent further comprises a ligand.

In one embodiment, the sense strand of the RNAi agent contains at least one motif of three identical modifications on three consecutive nucleotides, where one of the motifs occurs at the cleavage site in the sense strand.

In one embodiment, the antisense strand of the RNAi agent can also contain at least one motif of three identical modifications on three consecutive nucleotides, where one of the motifs occurs at or near the cleavage site in the antisense strand For an RNAi agent having a duplex region of 17-23 nucleotide in length, the cleavage site of the antisense strand is typically around the 10, 11 and 12 positions from the 5'-end. Thus the motifs of three identical modifications may occur at the 9, 10, 11 positions; 10, 11, 12 positions; 11, 12, 13 positions; 12, 13, 14 positions; or 13, 14, 15 positions of the antisense strand, the count starting from the $1^{st}$ nucleotide from the 5'-end of the antisense strand, or, the count starting from the $1^{st}$ paired nucleotide within the duplex region from the 5'-end of the antisense strand. The cleavage site in the antisense strand may also change according to the length of the duplex region of the RNAi from the 5'-end.

The sense strand of the RNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In one embodiment, the sense strand of the RNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adajacent to the first motif or is separated by at least one or more nucleotides. When the motifs are immediately adjacent to each other then the chemistry of the motifs are distinct from each other and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the RNAi agent may contain more than one motifs of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In one embodiment, the wing modification on the sense strand or antisense strand of the RNAi agent typically does not include the first one or two terminal nucleotides at the 3'-end, 5'-end or both ends of the strand.

In another embodiment, the wing modification on the sense strand or antisense strand of the RNAi agent typically does not include the first one or two paired nucleotides within the duplex region at the 3'-end, 5'-end or both ends of the strand.

When the sense strand and the antisense strand of the RNAi agent each contain at least one wing modification, the wing modifications may fall on the same end of the duplex region, and have an overlap of one, two or three nucleotides.

When the sense strand and the antisense strand of the RNAi agent each contain at least two wing modifications, the sense strand and the antisense strand can be so aligned that two modifications each from one strand fall on one end of the duplex region, having an overlap of one, two or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In one embodiment, every nucleotide in the sense strand and antisense strand of the RNAi agent, including the nucleotides that are part of the motifs, may be modified. Each nucleotide may be modified with the same or different modification which can include one or more alteration of one or both of the non-linking phosphate oxygens and/or of one or more of the linking phosphate oxygens; alteration of a constituent of the ribose sugar, e.g., of the 2' hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking 0 of a phosphate moiety. In some cases the modification will occur at all of the subject positions in the nucleic acid but in many cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of a RNA or may only occur in a single strand region of a RNA. For example, a phosphorothioate modification at a non-linking 0 position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. For example, it can be desirable to include purine nucleotides in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In one embodiment, each residue of the sense strand and antisense strand is independently modified with LNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In one embodiment, the $N_a$ and/or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AAB-BAABBAABB . . . ," "AABAABAABAAB . . . ," "AAABAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ", "ACACAC . . . " "BDBDBD . . . " or "CDCDCD . . . ," etc.

In one embodiment, the RNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 5'-3' of the strand within the duplex region. As another example, the alternating motif in the sense strand may start with "AABBAABB" from 5'-3' of the strand and the alternating motif in the antisense strand may start with "BBAABBAA" from 5'-3' of the strand within the duplex region, so that there is a complete or partial shift of the modification patterns between the sense strand and the antisense strand.

In one embodiment, the RNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand and/or antisense strand interrupts the initial modification pattern present in the sense strand and/or antisense strand. This interruption of the modification pattern of the sense and/or antisense strand by introducing one or more motifs of three identical modifications on three consecutive nucleotides to the sense and/or antisense strand surprisingly enhances the gene silencing acitivty to the target gene.

In one embodiment, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYY$N_b$ . . . ," where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Altnernatively, $N_a$ and/or $N_b$ may be present or absent when there is a wing modification present.

The RNAi agent may further comprise at least one phosphorothioate or methylphosphonate internucleotide linkage. The phosphorothioate or methylphosphonate internucleotide linkage modification may occur on any nucleotide of the sense strand or antisense strand or both strands in any position of the strand. For instance, the internucleotide linkage modification may occur on every nucleotide on the sense strand and/or antisense strand; each internucleotide linkage modification may occur in an alternating pattern on the sense strand and/or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-standed RNAi agent comprises 6-8phosphorothioate internucleotide linkages. In one embodiment, the antisense strand comprises two phosphorothioate internucleotide linkages at the 5'-terminus and two phosphorothioate internucleotide linkages at the 3'-terminus, and the sense strand comprises at least two phosphorothioate internucleotide linkages at either the 5'-terminus or the 3'-terminus.

In one embodiment, the RNAi comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, and/or the 5'end of the antisense strand.

In one embodiment, the 2 nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the RNAi agent may additionally have two phosphorothioate internucleotide linkages between the terminal three nucleotides at both the 5'-end of the sense strand and at the 5'-end of the antisense strand.

In one embodiment, the RNAi agent comprises mismatch (es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In one embodiment, the RNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In one embodiment, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

In another embodiment, the nucleotide at the 3'-end of the sense strand is deoxy-thymine (dT). In another embodiment, the nucleotide at the 3'-end of the antisense strand is deoxy-thymine (dT). In one embodiment, there is a short sequence of deoxy-thymine nucleotides, for example, two dT nucleotides on the 3'-end of the sense and/or antisense strand.

In one embodiment, the sense strand sequence may be represented by formula (I):

$$5'n_p\text{-}N_a\text{-}(XXX)_i\text{—}N_b\text{-}YYY\text{-}N_b\text{-}(ZZZ)_j\text{—}N_a\text{-}n_q3' \qquad (I)$$

wherein:

i and j are each independently 0 or 1;

p and q are each independently 0-6;

each $N_a$ independently represents an oligonucleotide sequence comprising 0-25 modified nucleotides, each sequence comprising at least two differently modified nucleotides;

each $N_b$ independently represents an oligonucleotide sequence comprising 0-10 modified nucleotides;

each $n_p$ and $n_q$ independently represent an overhang nucleotide;

wherein Nb and Y do not have the same modification; and XXX, YYY and ZZZ each independently represent one motif of three identical modifications on three consecutive nucleotides. Preferably YYY is all 2'-F modified nucleotides.

In one embodiment, the $N_a$ and/or $N_b$ comprise modifications of alternating pattern.

In one embodiment, the YYY motif occurs at or near the cleavage site of the sense strand. For example, when the RNAi agent has a duplex region of 17-23 nucleotides in length, the YYY motif can occur at or the vicinity of the cleavage site (e.g.: can occur at positions 6, 7, 8; 7, 8, 9; 8, 9, 10; 9, 10, 11; 10, 11, 12 or 11, 12, 13) of—the sense strand, the count starting from the 1$^{st}$ nucleotide, from the 5'-end; or optionally, the count starting at the 1$^{st}$ paired nucleotide within the duplex region, from the 5'-end.

In one embodiment, i is 1 and j is 0, or i is 0 and j is 1, or both i and j are 1. The sense strand can therefore be represented by the following formulas:

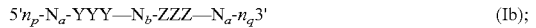  (Ib);

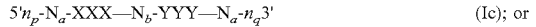  (Ic); or

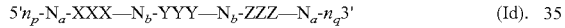  (Id).

When the sense strand is represented by formula (Ib), $N_b$ represents an oligonucleotide sequence comprising 0-10, 0-7, 0-5, 0-4, 0-2 or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2 or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2 or 0 modified nucleotides. Preferably, $N_b$ is 0, 1, 2, 3, 4, 5 or 6 Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

  (Ia).

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

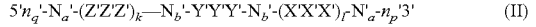  (II)

wherein:

k and l are each independently 0 or 1;

p' and q' are each independently 0-6;

each $N_a'$ independently represents an oligonucleotide sequence comprising 0-25 modified nucleotides, each sequence comprising at least two differently modified nucleotides;

each $N_b'$ independently represents an oligonucleotide sequence comprising 0-10 modified nucleotides;

each $n_p'$ and $n_q'$ independently represent an overhang nucleotide;

wherein $N_b'$ and Y' do not have the same modification; and

X'X'X', Y'Y'Y' and Z'Z'Z' each independently represent one motif of three identical modifications on three consecutive nucleotides.

In one embodiment, the $N_a'$ and/or $N_b'$ comprise modifications of alternating pattern.

The Y'Y'Y' motif occurs at or near the cleavage site of the antisense strand. For example, when the RNAi agent has a duplex region of 17-23 nucleotide in length, the Y'Y'Y' motif can occur at positions 9, 10, 11; 10, 11, 12; 11, 12, 13; 12, 13, 14; or 13, 14, 15 of the antisense strand, with the count starting from the 1$^{st}$ nucleotide, from the 5'-end; or optionally, the count starting at the 1$^{st}$ paired nucleotide within the duplex region, from the 5'-end. Preferably, the Y'Y'Y' motif occurs at positions 11, 12, 13.

In one embodiment, Y'Y'Y' motif is all 2'-OMe modified nucleotides.

In one embodiment, k is 1 and l is 0, or k is 0 and l is 1, or both k and l are 1.

The antisense strand can therefore be represented by the following formulas:

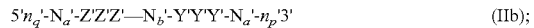  (IIb);

  (IIc); or

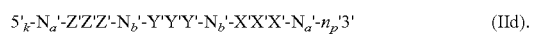  (IId).

When the antisense strand is represented by formula (IIb), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides. Preferably, $N_b$ is 0, 1, 2, 3, 4, 5 or 6.

In other embodiments, k is 0 and l is 0 and the antisense strand may be represented by the formula:

  (Ia).

When the antisense strand is represented as formula (IIa), each $N_a'$ independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In one embodiment, the sense strand of the RNAi agent may contain YYY motif occurring at 9, 10 and 11 positions of the strand when the duplex region is 21 nt, the count starting from the $1^{st}$ nucleotide from the 5'-end, or optionally, the count starting at the $1^{st}$ paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In one embodiment the antisense strand may contain Y'Y'Y' motif occurring at positions 11, 12, 13 of the strand, the count starting from the $1^{st}$ nucleotide from the 5'-end, or optionally, the count starting at the $1^{st}$ paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with a antisense strand being represented by any one of formulas (IIa), (IIb), (IIc), and (IId), respectively.

Accordingly, the RNAi agents for use in the methods of the invention may comprise a sense strand and an antisense strand, each strand having 14 to 30 nucleotides, the RNAi duplex represented by formula (III):

sense: 5'$n_p$-$N_a$-(XXX)$_i$-$N_b$-YYY-$N_b$-(ZZZ)$_j$-$N_a$-$n_q$3' antisense: 3'$n_p$'-$N_a$'-(X'X'X')$_k$-$N_b$'-Y'Y'Y'-$N_b$'-(Z'Z'Z')$_l$-$N_a$'-$n_q$'5'  (III)

wherein:

i, j, k, and l are each independently 0 or 1;

p, p', q, and q' are each independently 0-6;

each $N_a$ and $N_a$' independently represents an oligonucleotide sequence comprising 0-25 modified nucleotides, each sequence comprising at least two differently modified nucleotides;

each $N_b$ and $N_b$' independently represents an oligonucleotide sequence comprising 0-10 modified nucleotides;

wherein each $n_p$', $n_p$, $n_q$', and $n_q$, each of which may or may not be present, independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming a RNAi duplex include the formulas below:

5'$n_p$-$N_a$-YYY-$N_a$-$n_q$3'

3'$n_p$'-$N_a$'-Y'Y'Y'-$N_a$'$n_q$'5'  (IIIa)

5'$n_p$-$N_a$-YYY-$N_b$-ZZZ-$N_a$-$n_q$3'

3'$n_p$'-$N_a$'-Y'Y'Y'-$N_b$'-Z'Z'Z'—$N_a$'$n_q$'5'  (IIIb)

5'$n_p$-$N_a$-XXX-$N_b$-YYY-$N_a$-$n_q$3'

3'$n_p$'-$N_a$'-X'X'X'-$N_b$'-Y'Y'Y'-$N_a$'-$n_q$'5'  (IIIc)

5'$n_p$-$N_a$-XXX-$N_b$-YYY-$N_b$-ZZZ-$N_a$-$n_q$3'

3'$n_p$'-$N_a$'-X'X'X'-$N_b$'-Y'Y'Y'-$N_b$'-Z'Z'Z'—$N_a$-$n_q$'5'  (IIId)

When the RNAi agent is represented by formula (IIIa), each $N_a$ independently represents an oligonucleotide sequence comprising 2-20, 2-15, or 2-10 modified nucleotides.

When the RNAi agent is represented by formula (IIIb), each $N_b$ independently represents an oligonucleotide sequence comprising 1-10, 1-7, 1-5 or 1-4 modified nucleotides. Each $N_a$ independently represents an oligonucleotide sequence comprising 2-20, 2-15, or 2-10 modified nucleotides.

When the RNAi agent is represented as formula (IIIc), each $N_b$, $N_b$' independently represents an oligonucleotide sequence comprising 0-10, 0-7, 0-10, 0-7, 0-5, 0-4, 0-2 or 0 modified nucleotides. Each $N_a$ independently represents an oligonucleotide sequence comprising 2-20, 2-15, or 2-10 modified nucleotides.

When the RNAi agent is represented as formula (IIId), each $N_b$, $N_b$' independently represents an oligonucleotide sequence comprising 0-10, 0-7, 0-10, 0-7, 0-5, 0-4, 0-2 or 0 modified nucleotides. Each $N_a$, $N_a$' independently represents an oligonucleotide sequence comprising 2-20, 2-15, or 2-10 modified nucleotides. Each of $N_a$, $N_a$', $N_b$ and $N_b$' independently comprises modifications of alternating pattern.

Each of X, Y and Z in formulas (III), (IIIa), (IIIb), (IIIc), and (IIId) may be the same or different from each other.

When the RNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the RNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the RNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In one embodiment, the modification on the Y nucleotide is different than the modification on the Y' nucleotide, the modification on the Z nucleotide is different than the modification on the Z' nucleotide, and/or the modification on the X nucleotide is different than the modification on the X' nucleotide.

In one embodiment, when the RNAi agent is represented by formula (IIId), the $N_a$ modifications are 2'-O-methyl or 2'-fluoro modifications. In another embodiment, when the RNAi agent is represented by formula (IIId), the $N_a$ modifications are 2'-O-methyl or 2'-fluoro modifications and $n_p$'>0 and at least one $n_p$' is linked to a neighboring nucleotide via phosphorothioate linkage. In yet another embodiment, when the RNAi agent is represented by formula (IIId), the $N_a$ modifications are 2'-O-methyl or 2'-fluoro modifications, $n_p$'>0 and at least one $n_p$' is linked to a neighboring nucleotide via phosphorothioate linkage, and the sense strand is conjugated to one or more GalNAc derivatives attached through a bivalent or trivalent branched linker (described below). In another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, when the RNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, the RNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, the RNAi agent is a multimer containing three, four, five, six or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two RNAi agents represented by formula (III), (IIIa), (IIIb), (IIIc), and (IIId) are linked to each other at the 5' end, and one or both of the 3' ends and are optionally conjugated to to a ligand. Each of the agents can target the same gene or two different genes; or each of the agents can target same gene at two different target sites.

Various publications describe multimeric RNAi agents that can be used in the methods of the invention. Such publications include WO2007/091269, U.S. Pat. No. 7,858, 769, WO2010/141511, WO2007/117686, WO2009/014887 and WO2011/031520 the entire contents of each of which are hereby incorporated herein by reference.

As described in more detail below, the RNAi agent that contains conjugations of one or more carbohydrate moieties to a RNAi agent can optimize one or more properties of the RNAi agent. In many cases, the carbohydrate moiety will be attached to a modified subunit of the RNAi agent. For example, the ribose sugar of one or more ribonucleotide subunits of a dsRNA agent can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The RNAi agents may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and and decalin; preferably, the acyclic group is selected from serinol backbone or diethanolamine backbone.

In certain specific embodiments, the RNAi agent for use in the methods of the invention is an agent selected from the group of agents listed in any one of Tables 2 and 3. These agents may further comprise a ligand.

IV. iRNAs Conjugated to Ligands

Another modification of the RNA of an iRNA of the invention involves chemically linking to the RNA one or more ligands, moieties or conjugates that enhance the activity, cellular distribution or cellular uptake of the iRNA. Such moieties include but are not limited to lipid moieties such as a cholesterol moiety (Letsinger et al., (1989) *Proc. Natl. Acid. Sci. USA*, 86: 6553-6556), cholic acid (Manoharan et al., (1994) *Biorg. Med. Chem. Let.*, 4:1053-1060), a thioether, e.g., beryl-S-tritylthiol (Manoharan et al., (1992) *Ann. N.Y. Acad. Sci.*, 660:306-309; Manoharan et al., (1993) *Biorg. Med. Chem. Let.*, 3:2765-2770), a thiocholesterol (Oberhauser et al., (1992) *Nucl. Acids Res.*, 20:533-538), an aliphatic chain, e.g., dodecandiol or undecyl residues (Saison-Behmoaras et al., (1991) *EMBO J*, 10:1111-1118; Kabanov et al., (1990) *FEBS Lett.*, 259:327-330; Svinarchuk et al., (1993) *Biochimie*, 75:49-54), a phospholipid, e.g., di-hexadecyl-rac-glycerol or triethyl-ammonium 1,2-di-O-hexadecyl-rac-glycero-3-phosphonate (Manoharan et al., (1995) *Tetrahedron Lett.*, 36:3651-3654; Shea et al., (1990) *Nucl. Acids Res.*, 18:3777-3783), a polyamine or a polyethylene glycol chain (Manoharan et al., (1995) *Nucleosides & Nucleotides*, 14:969-973), or adamantane acetic acid (Manoharan et al., (1995) *Tetrahedron Lett.*, 36:3651-3654), a palmityl moiety (Mishra et al., (1995) *Biochim. Biophys. Acta*, 1264:229-237), or an octadecylamine or hexylaminocarbonyloxycholesterol moiety (Crooke et al., (1996) *J. Pharmacol. Exp. Ther.*, 277:923-937).

In one embodiment, a ligand alters the distribution, targeting or lifetime of an iRNA agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand. Preferred ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylglucosamine, N-acetylgalactosamine or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic.

Other examples of ligands include dyes, intercalating agents (e.g. acridines), cross-linkers (e.g. psoralen, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid,O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated oligonucleotides of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conujugates

In one embodiment, the ligand or conjugate is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, neproxin or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In a preferred embodiment, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another preferred embodiment, the lipid based ligand binds HSA weakly or not at all, such that the conjugate will be preferably distributed to the kidney. Other moieties that target to kidney cells can also be used in place of or in addition to the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 27). An RFGF analogue (e.g., amino acid sequence AALLPV-LLAAP (SEQ ID NO: 28) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 29) and the *Drosophila* Antennapedia protein (RQIKIWFQNRRMK-WKK (SEQ ID NO: 30) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glyciosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand. Preferred conjugates of this ligand target PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, a α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA oligonucleotide further comprises a carbohydrate. The carbohydrate conjugated iRNA are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In one embodiment, a carbohydrate conjugate for use in the compositions and methods of the invention is a monosaccharide. In another embodiment, a carbohydrate conjugate for use in the compositions and methods of the invention is selected from the group consisting of:

Formula II
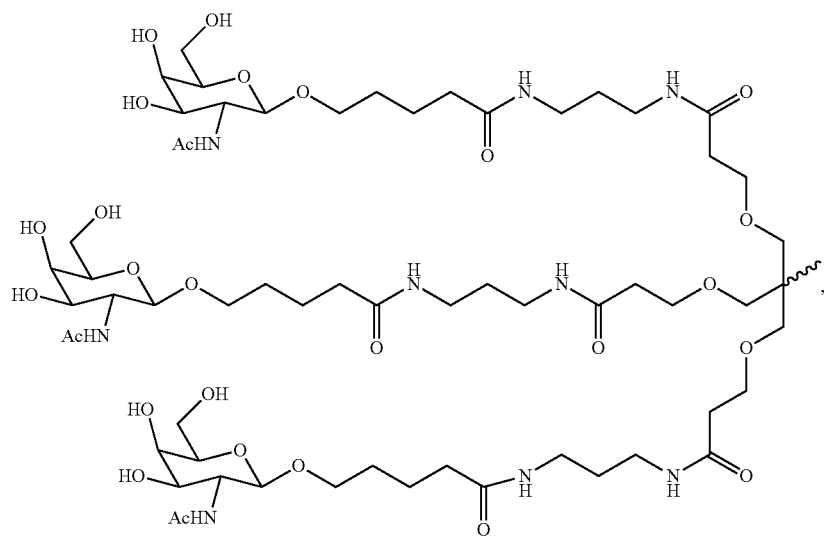
Formula III
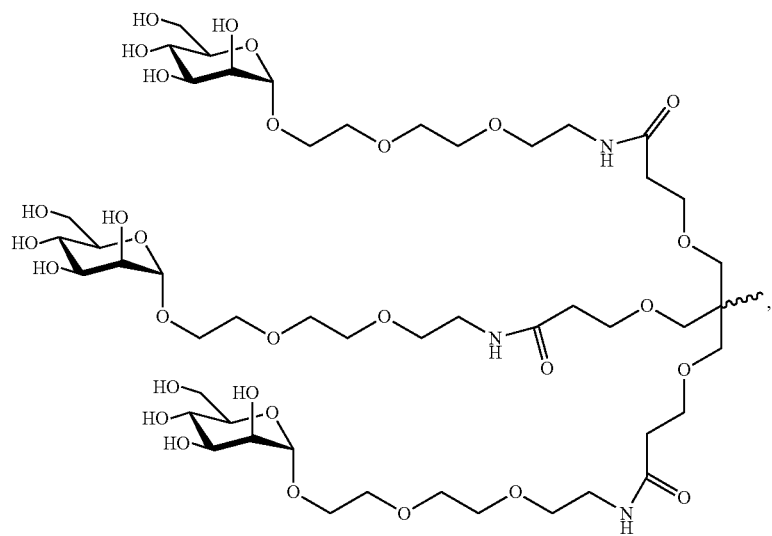
Formula IV
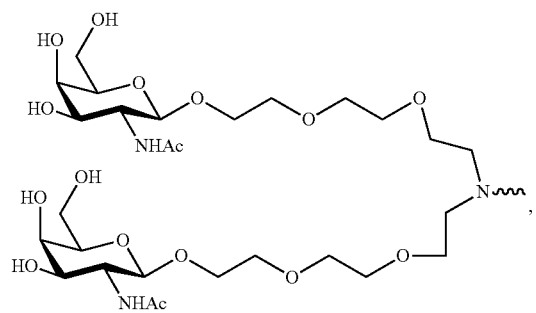
Formula V
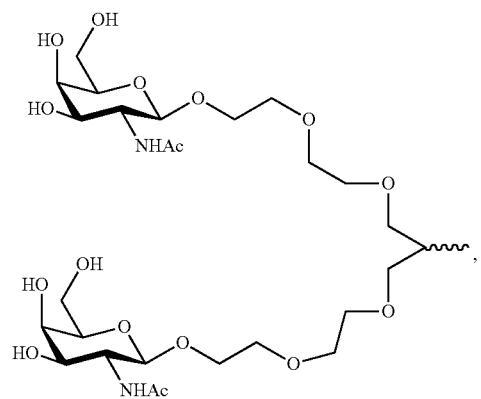

-continued
Formula VI
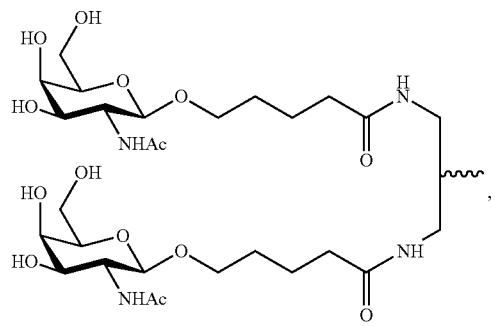
Formula VII
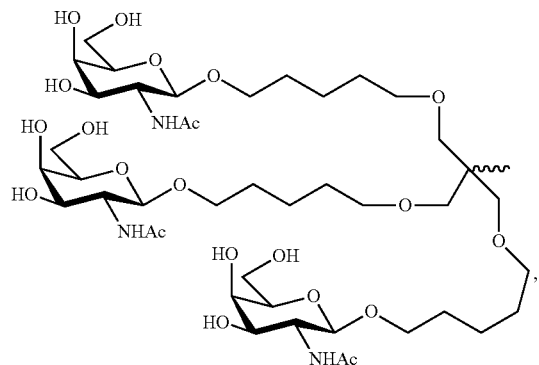
Formula VIII
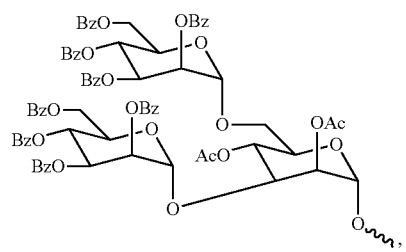
Formula IX
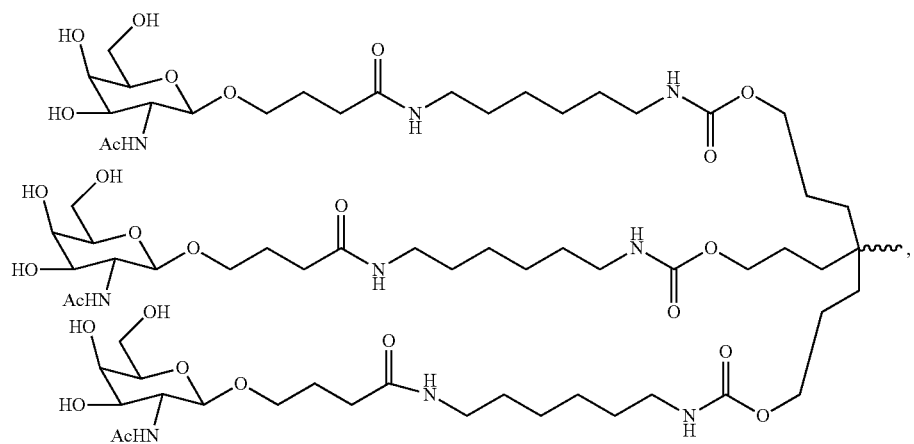
Formula X
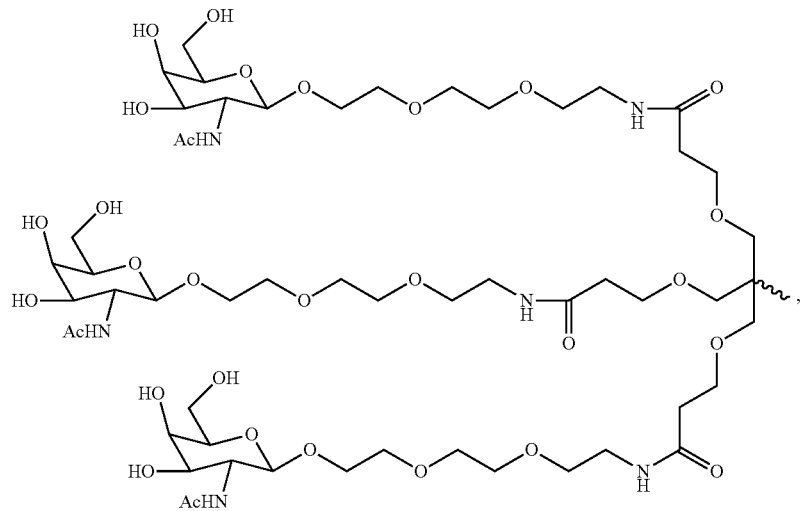

-continued
Formula XI
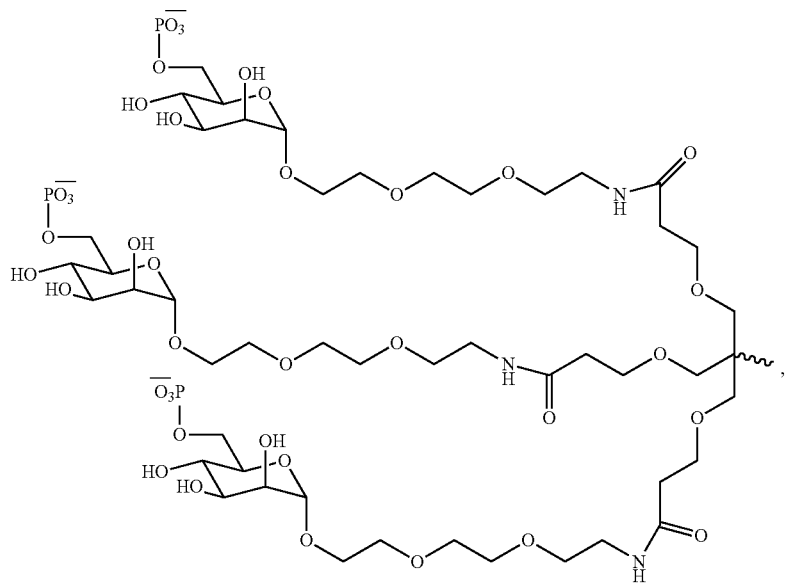
Formula XII
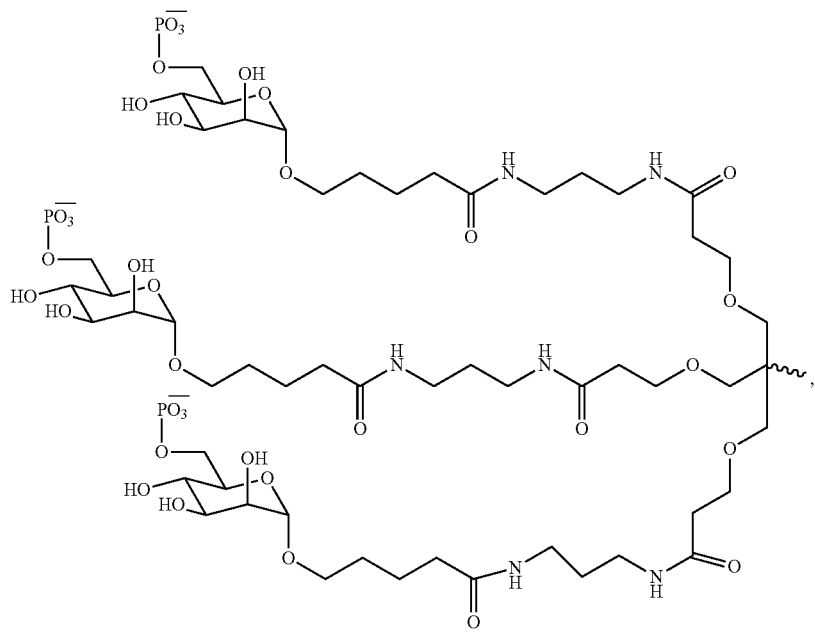
Formula XIII
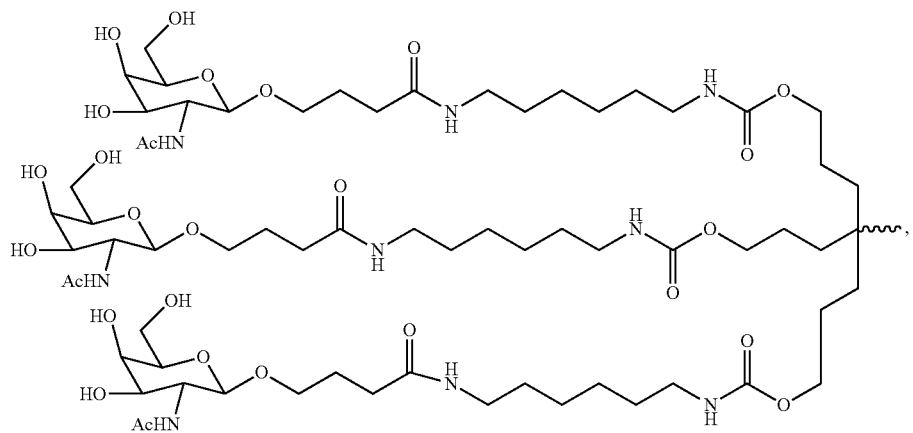

-continued
Formula XIV
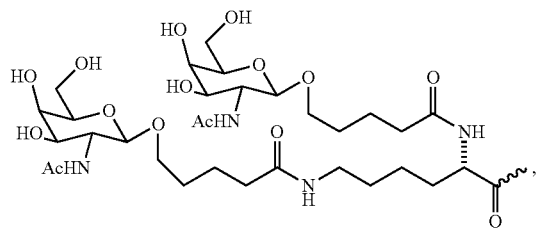
Formula XV
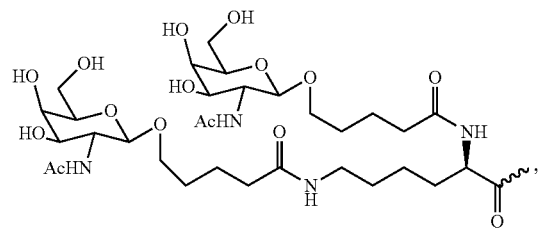
Formula XVI
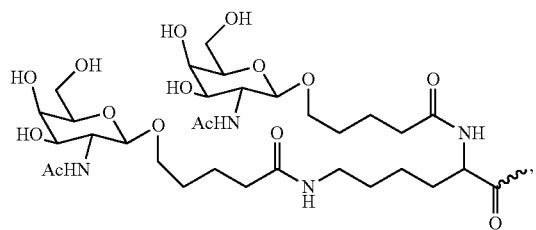
Formula XVII
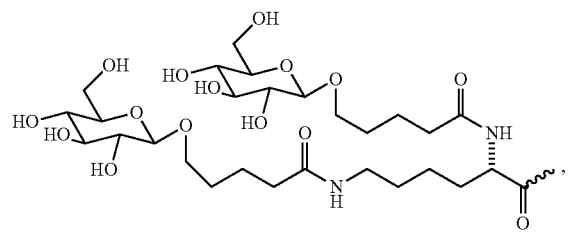
Formula XVIII
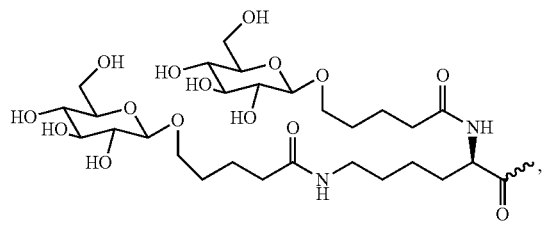
Formula XIX
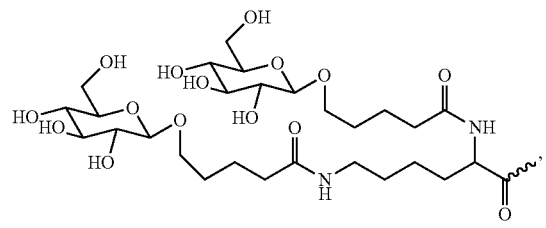
Formula XX
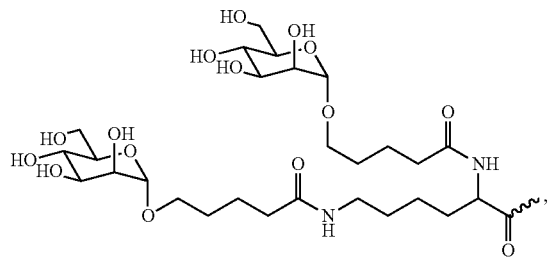
Formula XXI
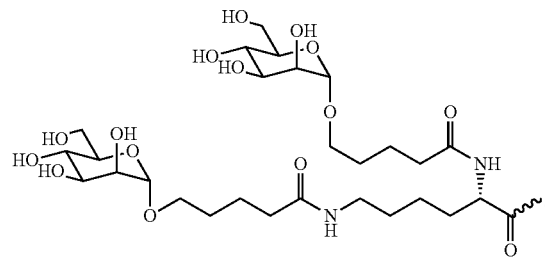
Formula XXII
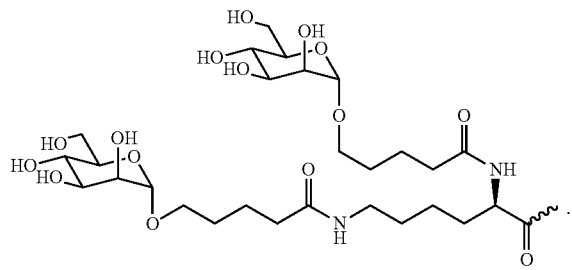

In one embodiment, the monosaccharide is an N-acetyl-galactosamine, such as

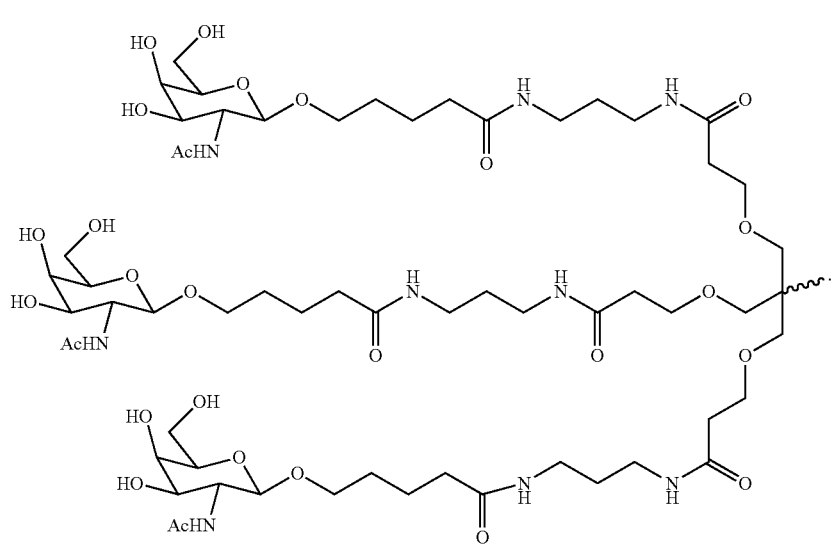

Formula II

Another representative carbohydrate conjugate for use in the embodiments described herein includes, but is not limited to, (Formula XXIII)

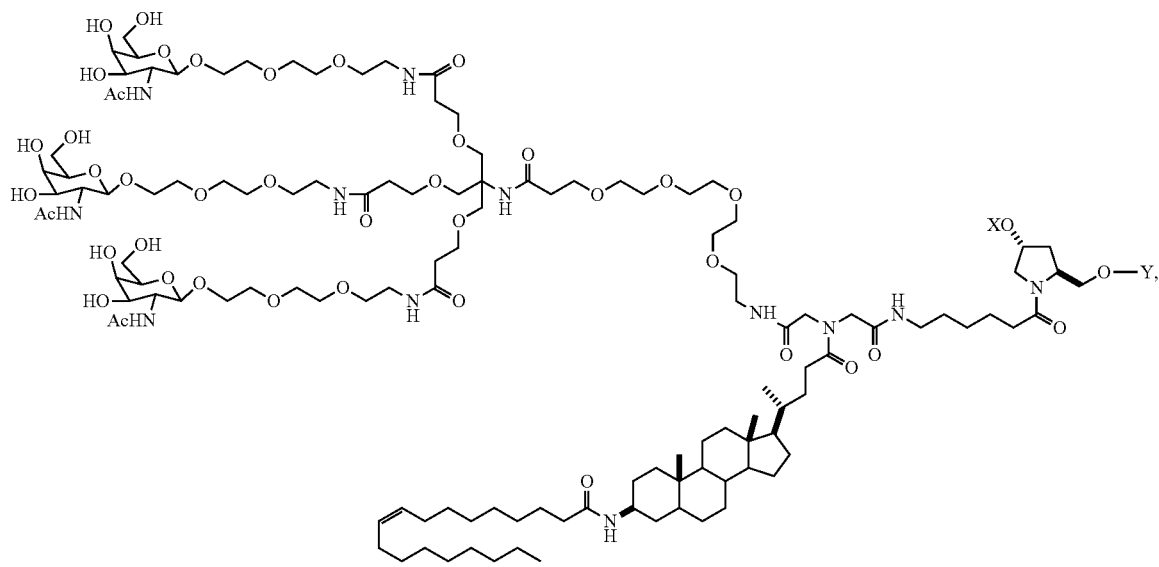

when one or X or Y is an oligonucleotide, the other is a hydrogen.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In one embodiment, the double stranded RNAi agents of the invention comprise one GalNAc or GalNAc derivative attached to the iRNA agent. In another embodiment, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, the carbohydrate conjugate further comprises one or more additional ligands as described above, such as, but not limited to, a PK modulator and/or a cell permeation peptide.

Additional carbohydrate conjugates (and linkers) suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NRB, C(O), C(O)NH, SO, $SO_2$, $SO_2$NH or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In one embodiment, the linker is between about 1-24 atoms, 2-24, 3-24, 4-24, 5-24, 6-24, 6-18, 7-18, 8-18 atoms, 7-17, 8-17, 6-16, 7-17, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

i. Redox Cleavable Linking Groups

In one embodiment, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In another embodiment, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, —O—P(S)(H)—S—. A preferred embodiment is —O—P(O)(OH)—O—. These candidates can be evaluated using methods analogous to those described above.

iii. Acid Cleavable Linking Groups

In another embodiment, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In another embodiment, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet another embodiment, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In one embodiment, an iRNA of the invention is conjugated to a carbohydrate through a linker. Non-limiting examples of iRNA carbohydrate conjugates with linkers of the compositions and methods of the invention include, but are not limited to, (Formula XXIV)

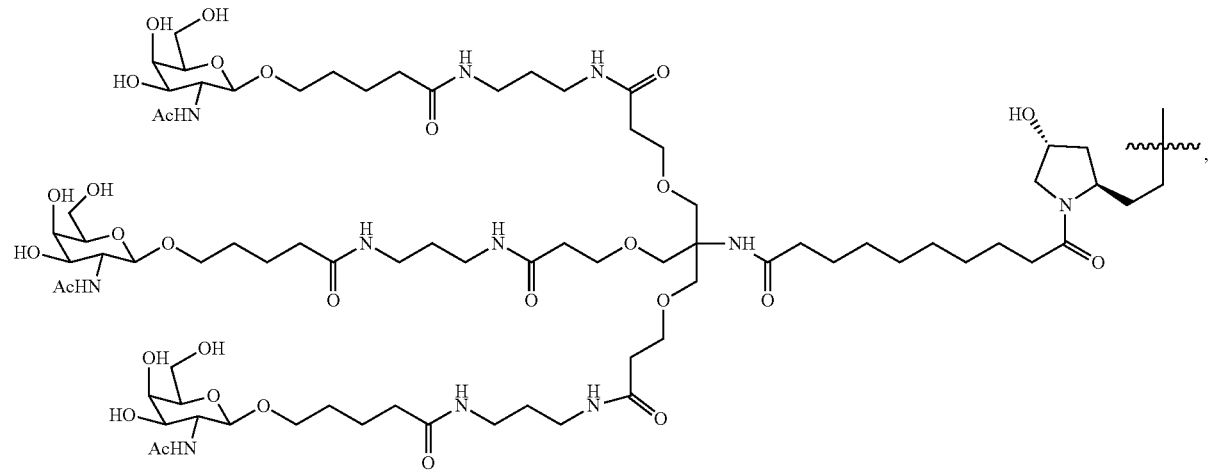

(Formula XXV)
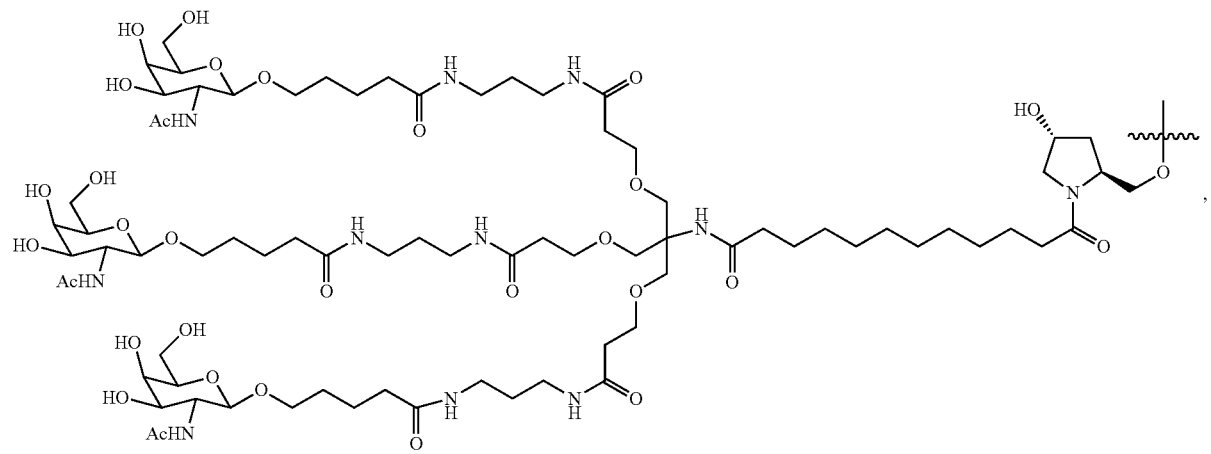
(Formula XXVI)
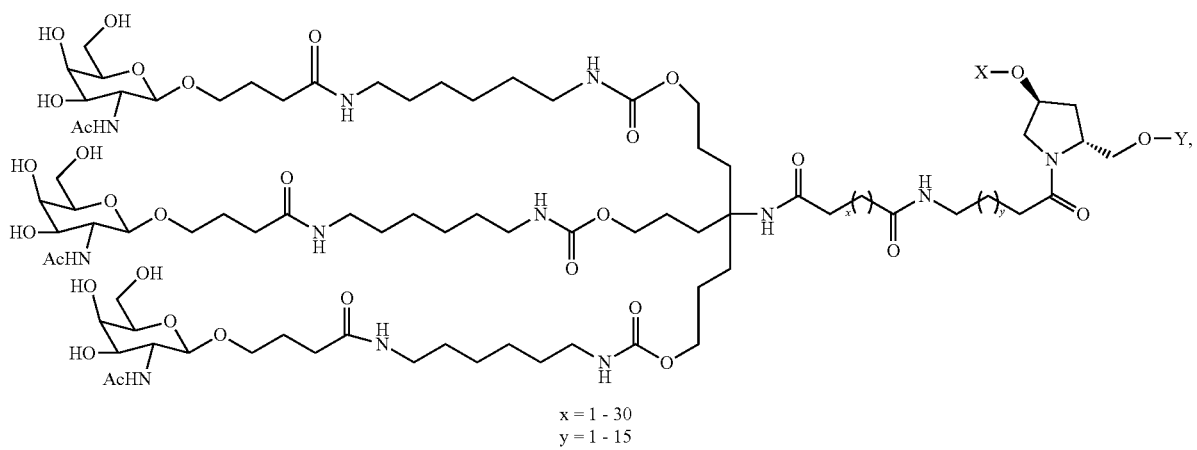
x = 1 - 30
y = 1 - 15
(Formula XXVII)
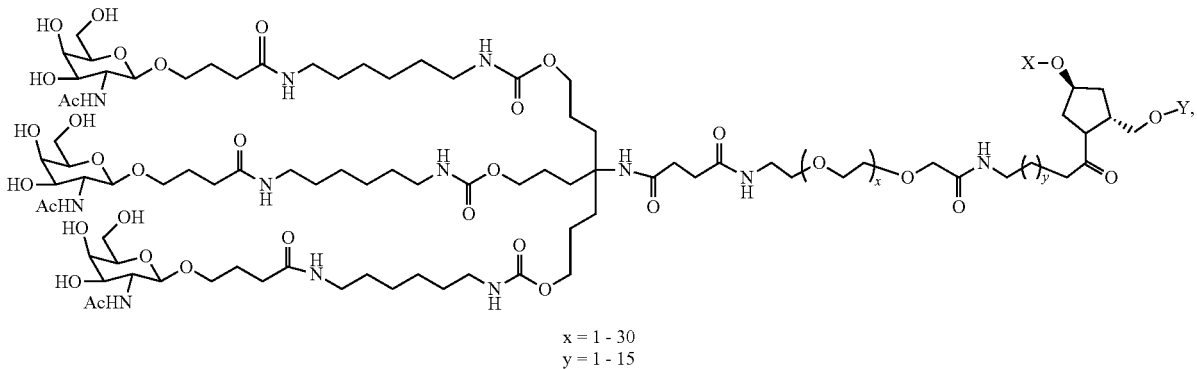
x = 1 - 30
y = 1 - 15

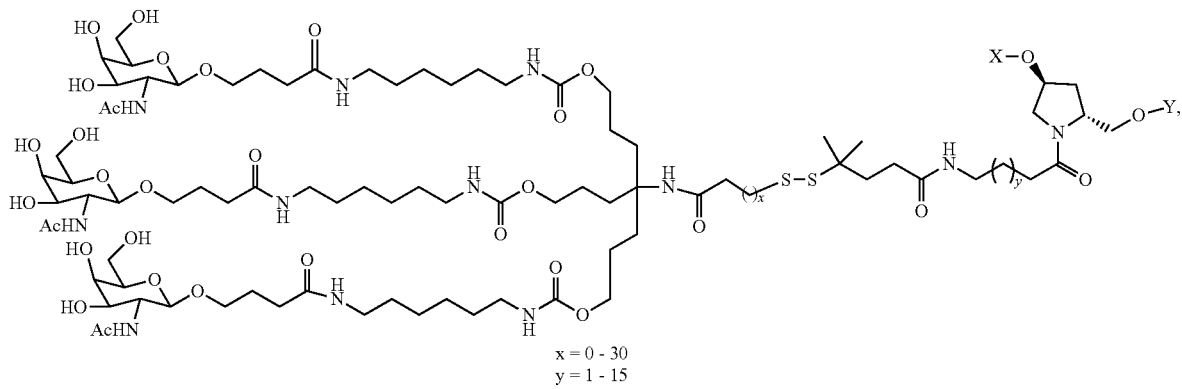
(Formula XXVIII)
x = 0 - 30
y = 1 - 15
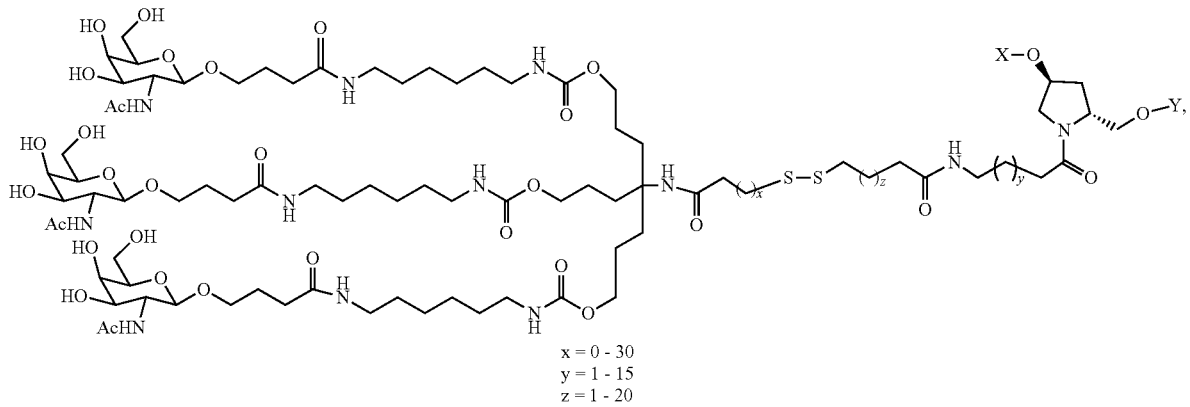
(Formula XXVIX)
x = 0 - 30
y = 1 - 15
z = 1 - 20
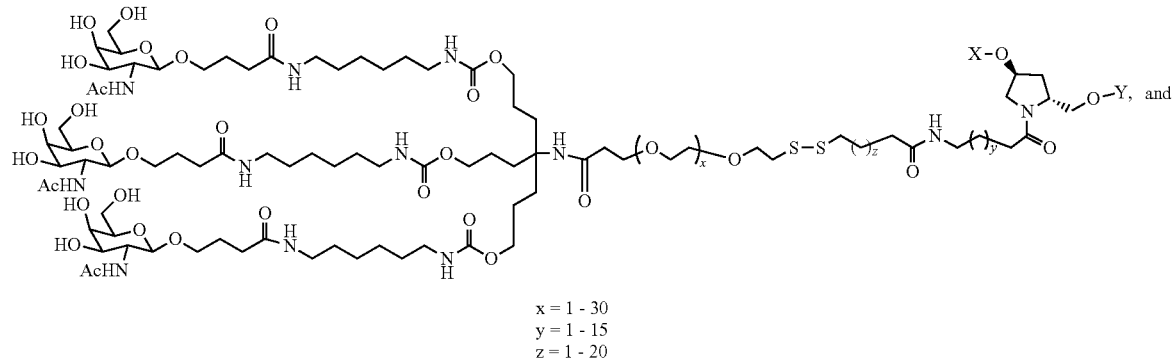
(Formula XXX)
x = 1 - 30
y = 1 - 15
z = 1 - 20
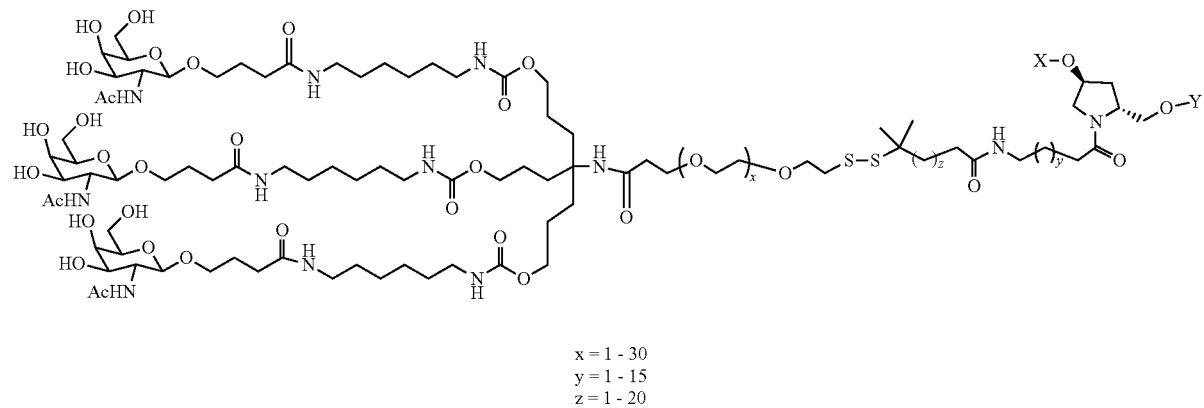
x = 1 - 30
y = 1 - 15
z = 1 - 20

(Formula XXXI), when one of X or Y is an oligonucleotide, the other is a hydrogen.

In certain embodiments of the compositions and methods of the invention, a ligand is one or more GalNAc (N-acetyl-galactosamine) derivatives attached through a bivalent or trivalent branched linker.

In one embodiment, a dsRNA of the invention is conjugated to a bivalent or trivalent branched linker selected from the group of structures shown in any of formula (XXXII)-(XXXV):

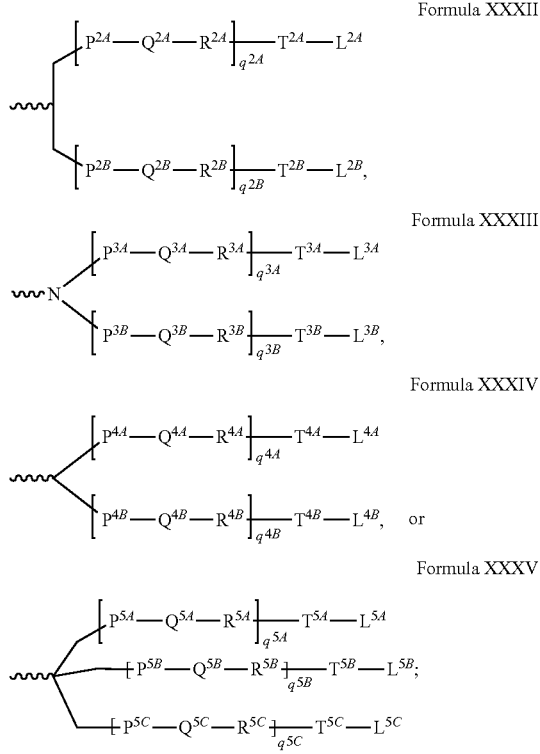

wherein:
q2A, q2B, q3A, q3B, q4A, q4B, q5A, q5B and q5C represent independently for each occurrence 0-20 and wherein the repeating unit can be the same or different;
$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), CH$_2$, CH$_2$NH or CH$_2$O;
$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), SO$_2$, N(R$^N$), C(R')=C(R''), C≡C or C(O); $R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, CH$_2$, C(O)O, C(O)NH, NHCH(R$^a$)C(O), —C(O)—CH(R$^a$)—NH—, CO,

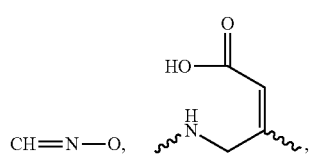

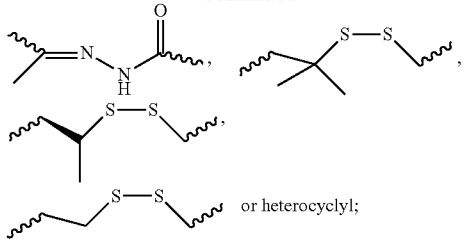

or heterocyclyl;

$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and R$^a$ is H or amino acid side chain. Trivalent conjugating GalNAc derivatives are particularly useful for use with RNAi agents for inhibiting the expression of a target gene, such as those of formula (XXXVI):

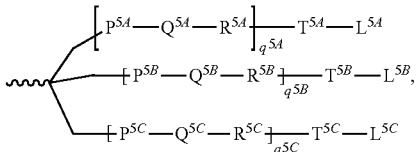

wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, preferably dsRNAs, which contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, and/or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., Biochem. Biophys. Res. Comm, 2007, 365(1):54-61; Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-S-tritylthiol (Manoharan et al., Ann. N.Y. Acad. Sci., 1992, 660:306; Manoharan et al., Bioorg. Med. Chem. Let., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such RNA conjugates have been listed above. Typical conjugation protocols involve the synthesis of an RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

IV. Delivery of an iRNA of the Invention

The delivery of an iRNA of the invention to a cell e.g., a cell within a subject, such as a human subject (e.g., a subject in need thereof, such as a subject having a SCAP-associated disorder, e.g., Nonalcoholic Fatty Liver Disease (NAFLD), e.g., nonalcoholic steatohepatitis (NASH)) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian R L., (1992) Trends Cell. Biol. 2(5):139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. The non-specific effects of an iRNA can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the iRNA molecule to be administered. Several studies have shown successful knockdown of gene products when an iRNA is administered locally. For example, intraocular delivery of a VEGF dsRNA by intravitreal injection in cynomolgus monkeys (Tolentino, M J. et al., (2004) Retina 24:132-138) and subretinal injections in mice (Reich, S J. et al. (2003) Mol. Vis. 9:210-216) were both shown to prevent neovascularization in an experimental model of age-related macular degeneration. In addition, direct intratumoral injection of a dsRNA in mice reduces tumor volume (Pille, J. et al. (2005) Mol. Ther. 11:267-274) and can prolong survival of tumor-bearing mice (Kim, W J. et al., (2006) Mol. Ther. 14:343-350; Li, S. et al., (2007) Mol. Ther. 15:515-523). RNA interference has also shown success with local delivery to the CNS by direct injection (Dorn, G. et al., (2004) Nucleic Acids 32:e49; Tan, P H. et al. (2005) Gene Ther. 12:59-66; Makimura, H. et al (2002) BMC Neurosci. 3:18; Shishkina, G T., et al. (2004) Neuroscience 129:521-528; Thakker, E R., et al. (2004) Proc. Natl. Acad. Sci. U.S.A. 101:17270-17275; Akaneya, Y., et al. (2005) J. Neurophysiol. 93:594-602) and to the lungs by intranasal administration (Howard, K A. et al., (2006) Mol. Ther. 14:476-484; Zhang, X. et al., (2004) J. Biol. Chem. 279:10677-10684; Bitko, V. et al., (2005) Nat. Med. 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the iRNA composition to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J. et al., (2004) Nature 432:173-178). Conjugation of an iRNA to an aptamer has been shown to inhibit tumor growth and mediate tumor regression in a mouse model of prostate cancer (McNamara, J O. et al., (2006) Nat. Biotechnol. 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H. et al., (2008) *Journal of Controlled Release* 129(2):107-116) that encases an iRNA. The formation of vesicles or micelles further prevents degradation of the iRNA when administered systemically. Methods for making and administering cationic—iRNA complexes are well within the abilities of one skilled in the art (see e.g., Sorensen, D R., et al. (2003) *J. Mol. Biol* 327:761-766; Verma, U N. et al., (2003) *Clin. Cancer Res.* 9:1291-1300; Arnold, A S et al., (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N. et al., (2003), supra), Oligofectamine, "solid nucleic acid lipid particles" (Zimmermann, T S. et al., (2006) *Nature* 441:111-114), cardiolipin (Chien, P Y. et al., (2005) *Cancer Gene Ther.* 12:321-328; Pal, A. et al., (2005) *Int J. Oncol.* 26:1087-1091), polyethyleneimine (Bonnet M E. et al., (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A. et al., (2007) *Biochem. Soc. Trans.* 35:61-67; Yoo, H. et al., (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector Encoded iRNAs of the Invention iRNA targeting the SCAP gene can be expressed from transcription units inserted into DNA or RNA vectors (see, e.g., Couture, A, et al., *TIG.* (1996), 12:5-10; Skillern, A., et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., (1995) *Proc. Natl. Acad. Sci. USA* 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

iRNA expression vectors are generally DNA plasmids or viral vectors. Expression vectors compatible with eukaryotic cells, preferably those compatible with vertebrate cells, can be used to produce recombinant constructs for the expression of an iRNA as described herein. Eukaryotic cell expression vectors are well known in the art and are available from a number of commercial sources. Typically, such vectors are provided containing convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are known in the art.

V. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for treating a disease or disorder associated with the expression or activity of a SCAP gene, e.g., a SCAP-associated disease, e.g., Nonalcoholic Fatty Liver Disease (NAFLD), e.g., non-alcoholic steatohepatitis (NASH).

Such pharmaceutical compositions are formulated based on the mode of delivery. One example is compositions that are formulated for systemic administration via parenteral delivery, e.g., by intravenous (IV), intramuscular (IM), or for subcutaneous (subQ) delivery. Another example is compositions that are formulated for direct delivery into the liver, e.g., by infusion into the liver, such as by continuous pump infusion.

The pharmaceutical compositions of the invention may be administered in dosages sufficient to inhibit expression of a SCAP gene. In general, a suitable dose of an iRNA of the invention will be in the range of about 0.001 to about 200.0 milligrams per kilogram body weight of the recipient per day, generally in the range of about 1 to 50 mg per kilogram body weight per day. Typically, a suitable dose of an iRNA of the invention will be in the range of about 0.1 mg/kg to about 5.0 mg/kg, preferably about 0.3 mg/kg and about 3.0 mg/kg.

A repeat-dose regimine may include administration of a therapeutic amount of iRNA on a regular basis, such as every other day to once a year. In certain embodiments, the iRNA is administered about once per month to about once per quarter (i.e., about once every three months).

After an initial treatment regimen, the treatments can be administered on a less frequent basis.

The pharmaceutical composition can be administered once daily, or the iRNA can be administered as two, three, or more sub-doses at appropriate intervals throughout the day or even using continuous infusion or delivery through a controlled release formulation. In that case, the iRNA contained in each sub-dose must be correspondingly smaller in order to achieve the total daily dosage. The dosage unit can also be compounded for delivery over several days, e.g., using a conventional sustained release formulation which provides sustained release of the iRNA over a several day period. Sustained release formulations are well known in the art and are particularly useful for delivery of agents at a particular site, such as could be used with the agents of the present invention. In this embodiment, the dosage unit contains a corresponding multiple of the daily dose.

In other embodiments, a single dose of the pharmaceutical compositions can be long lasting, such that subsequent doses are administered at not more than 3, 4, or 5 day intervals, or at not more than 1, 2, 3, or 4 week intervals. In some embodiments of the invention, a single dose of the pharmaceutical compositions of the invention is administered once per week. In other embodiments of the invention, a single dose of the pharmaceutical compositions of the invention is administered bi-monthly.

The skilled artisan will appreciate that certain factors can influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual iRNAs encompassed by the invention can be made using conventional methodologies or on the basis of in vivo testing using an appropriate animal model, as described elsewhere herein.

Advances in mouse genetics have generated a number of mouse models for the study of various human diseases, such as SCAP-associated disorders that would benefit from reduction in the expression of SCAP. Such models can be used for in vivo testing of iRNA, as well as for determining a therapeutically effective dose. Suitable mouse models are known in the art and include, for example, an obese (ob/ob) mouse containing a mutation in the obese (ob) gene (Wiegman et al., (2003) *Diabetes*, 52:1081-1089); a mouse containing homozygous knock-out of an LDL receptor (LDLR–/– mouse; Ishibashi et al., (1993) *J Clin Invest* 92(2):883-893); diet-induced artherosclerosis mouse model (Ishida et al., (1991) *J. Lipid. Res.*, 32:559-568); and heterozygous lipoprotein lipase knockout mouse model (Weistock et al., (1995) J. Clin. Invest. 96(6):2555-2568).

The pharmaceutical compositions of the present invention can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The iRNA can be delivered in a manner to target a particular tissue, such as the liver (e.g., the hepatocytes of the liver).

Pharmaceutical compositions and formulations for topical administration can include transdermal patches, ointments, lotions, creams, gels, drops, suppositories, sprays, liquids and powders. Conventional pharmaceutical carriers, aqueous, powder or oily bases, thickeners and the like can be necessary or desirable. Coated condoms, gloves and the like can also be useful. Suitable topical formulations include those in which the iRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). iRNAs featured in the invention can be encapsulated within liposomes or can form complexes thereto, in particular to cationic liposomes. Alternatively, iRNAs can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

A. iRNA Formulations Comprising Membranous Molecular Assemblies

An iRNA for use in the compositions and methods of the invention can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the iRNA composition. The lipophilic material isolates the aqueous interior from an aqueous exterior, which typically does not include the iRNA composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the iRNA are delivered into the cell where the iRNA can specifically bind to a target RNA and can mediate RNAi. In some cases the liposomes are also specifically targeted, e.g., to direct the iRNA to particular cell types.

A liposome containing a RNAi agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The RNAi agent preparation is then added to the micelles that include the lipid component. The cationic groups on the lipid interact with the RNAi agent and condense around the RNAi agent to form a liposome. After condensation, the detergent is removed, e.g., by dialysis, to yield a liposomal preparation of RNAi agent.

If necessary a carrier compound that assists in condensation can be added during the condensation reaction, e.g., by controlled addition. For example, the carrier compound can be a polymer other than a nucleic acid (e.g., spermine or spermidine). pH can also adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Feigner, P. L. et al., (1987) *Proc. Natl. Acad. Sci. USA* 8:7413-7417; U.S. Pat. Nos. 4,897,355; 5,171,678; Bangham et al., (1965) *M. Mol. Biol.* 23:238; Olson et al., (1979) *Biochim. Biophys. Acta* 557:9; Szoka et al., (1978) *Proc. Natl. Acad. Sci.* 75: 4194; Mayhew et al., (1984) *Biochim. Biophys. Acta* 775:169; Kim et al., (1983) *Biochim. Biophys. Acta* 728:339; and Fukunaga et al., (1984) *Endocrinol.* 115:757. Commonly used techniques for preparing lipid aggregates of appropriate size for use as delivery vehicles include sonication and freeze-thaw plus extrusion (see, e.g., Mayer et al., (1986) *Biochim. Biophys. Acta* 858:161. Microfluidization can be used when consistently small (50 to 200 nm) and relatively uniform aggregates are desired (Mayhew et al., (1984) *Biochim. Biophys. Acta* 775:169. These methods are readily adapted to packaging RNAi agent preparations into liposomes.

Liposomes fall into two broad classes. Cationic liposomes are positively charged liposomes which interact with the negatively charged nucleic acid molecules to form a stable complex. The positively charged nucleic acid/liposome complex binds to the negatively charged cell surface and is internalized in an endosome. Due to the acidic pH within the endosome, the liposomes are ruptured, releasing their contents into the cell cytoplasm (Wang et al. (1987) *Biochem. Biophys. Res. Commun.*, 147:980-985).

Liposomes, which are pH-sensitive or negatively charged, entrap nucleic acids rather than complex with them. Since both the nucleic acid and the lipid are similarly charged, repulsion rather than complex formation occurs. Nevertheless, some nucleic acid is entrapped within the aqueous interior of these liposomes. pH sensitive liposomes have been used to deliver nucleic acids encoding the thymidine kinase gene to cell monolayers in culture. Expression of the exogenous gene was detected in the target cells (Zhou et al. (1992) *Journal of Controlled Release*, 19:269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Examples of other methods to introduce liposomes into cells in vitro and in vivo include U.S. Pat. Nos. 5,283,185; 5,171,678; WO 94/00569; WO 93/24640; WO 91/16024; Feigner, (1994) *J. Biol. Chem.* 269:2550; Nabel, (1993) *Proc. Natl. Acad. Sci.* 90:11307; Nabel, (1992) *Human Gene Ther.* 3:649; Gershon, (1993) *Biochem.* 32:7143; and Strauss, (1992) *EMBO J.* 11:417.

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporine A into different layers of the skin (Hu et al., (1994) *S.T.P.Pharma. Sci.*, 4(6):466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., (1987) *FEBS Letters*, 223:42; Wu et al., (1993) *Cancer Research*, 53:3765).

Various liposomes comprising one or more glycolipids are known in the art. Papahadjopoulos et al. (*Ann. N.Y. Acad. Sci.*, (1987), 507:64) reported the ability of monosialoganglio side $G_{M1}$, galactocerebroside sulfate and phosphatidylinositol to improve blood half-lives of liposomes. These findings were expounded upon by Gabizon et al. (*Proc. Natl. Acad. Sci. U.S.A.*, (1988), 85:6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

In one embodiment, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver RNAi agents to macrophages.

Further advantages of liposomes include: liposomes obtained from natural phospholipids are biocompatible and biodegradable; liposomes can incorporate a wide range of water and lipid soluble drugs; liposomes can protect encapsulated RNAi agents in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of RNAi agent (see, e.g., Feigner, P. L. et al., (1987) *Proc. Natl. Acad. Sci. USA* 8:7413-7417, and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Ind.) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wis.) and dipalmitoyl-phosphatidylethanolamine 5-carboxyspermyl-amide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., (1991) *Biochim. Biophys. Res. Commun.* 179:280). Lipopolylysine, made by conjugating polylysine to DOPE, has been reported to be effective for transfection in the presence of serum (Zhou, X. et al., (1991) *Biochim. Biophys. Acta* 1065:8). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, Calif.) and Lipofectamine (DOSPA) (Life Technology, Inc., Gaithersburg, Md.). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer RNAi agent into the skin. In some implementations, liposomes are used for delivering RNAi agent to epidermal cells and also to enhance the penetration of RNAi agent into dermal tissues, e.g., into skin. For example, the liposomes can be applied topically. Topical delivery of drugs formulated as liposomes to the skin has been documented (see, e.g., Weiner et al., (1992) *Journal of Drug Targeting*, vol. 2,405-410 and du Plessis et al., (1992) *Antiviral Research*, 18:259-265; Mannino, R. J. and Fould-Fogerite, S., (1998) *Biotechniques* 6:682-690; Itani, T. et al., (1987) *Gene* 56:267-276; Nicolau, C. et al. (1987) *Meth. Enzymol.* 149:157-176; Straubinger, R. M. and Papahadjopoulos, D. (1983) *Meth. Enzymol.* 101:512-527; Wang, C. Y. and Huang, L., (1987) *Proc. Natl. Acad. Sci. USA* 84:7851-7855).

Non-ionic liposomal systems have also been examined to determine their utility in the delivery of drugs to the skin, in particular systems comprising non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) were used to deliver a drug into the dermis of mouse skin. Such formulations with RNAi agent are useful for treating a dermatological disorder.

Liposomes that include iRNA can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include RNAi agent can be delivered, for example, subcutaneously by infection in order to deliver RNAi agent to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

Other formulations amenable to the present invention are described in U.S. provisional application Ser. No. 61/018,616, filed Jan. 2, 2008; 61/018,611, filed Jan. 2, 2008; 61/039,748, filed Mar. 26, 2008; 61/047,087, filed Apr. 22, 2008 and 61/051,528, filed May 8, 2008. PCT application no PCT/US2007/080331, filed Oct. 3, 2007 also describes formulations that are amenable to the present invention.

Transfersomes are yet another type of liposomes, and are highly deformable lipid aggregates which are attractive candidates for drug delivery vehicles. Transfersomes can be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

The iRNA for use in the methods of the invention can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the siRNA composition, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Phenol and/or m-cresol may be added to the mixed micellar composition to stabilize the formulation and protect against bacterial growth. Alternatively, phenol and/or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

B. Lipid Particles iRNAs, e.g., dsRNAs of in the invention may be fully encapsulated in a lipid formulation, e.g., a LNP, or other nucleic acid-lipid particle.

As used herein, the term "LNP" refers to a stable nucleic acid-lipid particle. LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586, 410; 6,815,432; U.S. Publication No. 2010/0324120 and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the invention.

The cationic lipid can be, for example, N,N-dioleyl-N,N-dimethylammonium chloride (DODAC), N,N-distearyl-N, N-dimethylammonium bromide (DDAB), N—(I-(2,3-dioleoyloxy)propyl)-N,N,N-trimethylammonium chloride (DOTAP), N—(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino) acetoxypropane (DLin-DAC), 1,2-Dilinoleyoxy-3- morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyetetrahydro-3aH-cyclopenta[d][1,3]dioxol-5-amine (ALN100), (6Z,9Z,28Z,31Z)-heptatriaconta-6,9,28,31-tetraen-19-yl4-(dimethylamino)butanoate (MC3), 1,1'-(2-(4-(2-((2-(bis(2-hydroxydodecyl)amino)ethyl)(2-hydroxydodecyl)amino)ethyl)piperazin-1-yeethylazanediyedidodecan-2-ol (Tech G1), or a mixture thereof. The cationic lipid can comprise from about 20 mol % to about 50 mol % or about 40 mol % of the total lipid present in the particle.

In another embodiment, the compound 2,2-Dilinoleyl-4-dimethylaminoethyl-[1,3]-dioxolane can be used to prepare lipid-siRNA nanoparticles. Synthesis of 2,2-Dilinoleyl-4-dimethylaminoethyl-[1,3]-dioxolane is described in U.S. provisional patent application No. 61/107,998 filed on Oct. 23, 2008, which is herein incorporated by reference.

In one embodiment, the lipid-siRNA particle includes 40% 2, 2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The ionizable/non-cationic lipid can be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid can be from about 5 mol % to about 90 mol %, about 10 mol %, or about 58 mol % if cholesterol is included, of the total lipid present in the particle.

The conjugated lipid that inhibits aggregation of particles can be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate can be, for example, a PEG-dilauryloxypropyl ($Ci_2$), a PEG-dimyristyloxypropyl ($Ci_4$), a PEG-dipalmityloxypropyl ($Ci_6$), or a PEG-distearyloxypropyl ($C]_8$). The conjugated lipid that prevents aggregation of particles can be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

In one embodiment, the lipidoid ND98.4HCl (MW 1487) (see U.S. patent application Ser. No. 12/056,230, filed Mar. 26, 2008, which is incorporated herein by reference), Cholesterol (Sigma-Aldrich), and PEG-Ceramide C16 (Avanti Polar Lipids) can be used to prepare lipid-dsRNA nanoparticles (i.e., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

Formula 1

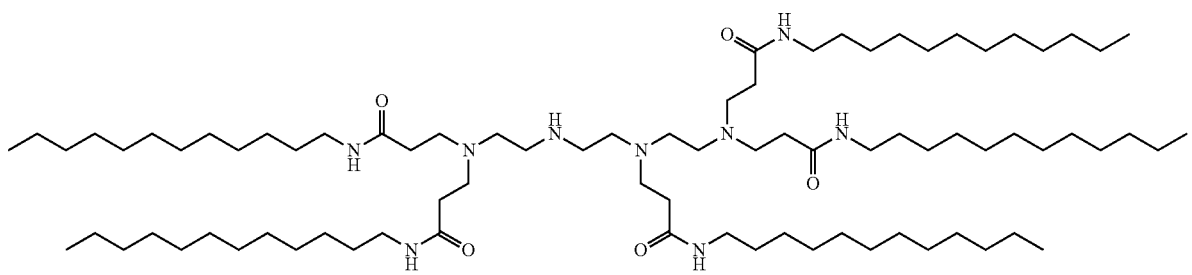

ND98 Isomer I

LNP01 formulations are described, e.g., in International Application Publication No. WO 2008/042973, which is hereby incorporated by reference.

Additional exemplary lipid-dsRNA formulations are described in the table below.

PEG-DSG: PEG-distyryl glycerol (C18-PEG, or PEG-C18) (PEG with avg mol wt of 2000)

PEG-cDMA: PEG-carbamoyl-1,2-dimyristyloxypropylamine (PEG with avg mol wt of 2000)

|  | Ionizable/Cationic Lipid | cationic lipid/non-cationic lipid/cholesterol/PEG-lipid conjugate Lipid:siRNA ratio |
|---|---|---|
| SNALP-1 | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA~7:1 |
| 2-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA~7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA~6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA~11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1) | Tech G1/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

DSPC: distearoylphosphatidylcholine
DPPC: dipalmitoylphosphatidylcholine
PEG-DMG: PEG-didimyristoyl glycerol (C14-PEG, or PEG-C14) (PEG with avg mol wt of 2000)

SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.

XTC comprising formulations are described in PCT Publication No. WO 2010/088537, the entire contents of which are hereby incorporated herein by reference.

MC3 comprising formulations are described, e.g., in U.S. Publication No. 2010/0324120, filed Jun. 10, 2010, the entire contents of which are hereby incorporated by reference.

ALNY-100 comprising formulations are described in PCT Publication No. WO 2010/054406, the entire contents of which are hereby incorporated herein by reference.

C12-200 comprising formulations are described in PCT Publication No. WO 2010/129709, the entire contents of which are hereby incorporated herein by reference.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders can be desirable. In some embodiments, oral formulations are those in which dsRNAs featured in the invention are administered in conjunction with one or more penetration enhancer surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention can be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US PubIn. No. 20030027780, and U.S. Pat. No. 6,747,014, each of which is incorporated herein by reference.

Compositions and formulations for parenteral, intraparenchymal (into the brain), intrathecal, intraventricular or intrahepatic administration can include sterile aqueous solutions which can also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions can be generated from a variety of components that include, but are not limited to, preformed liquids, self-emulsifying solids and self-emulsifying semisolids. Particularly preferred are formulations that target the liver when treating hepatic disorders such as hepatic carcinoma.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention can be formulated into any of many possible dosage forms such as, but not limited to, tablets, capsules, gel capsules, liquid syrups, soft gels, suppositories, and enemas. The compositions of the present invention can also be formulated as suspensions in aqueous, non-aqueous or mixed media. Aqueous suspensions can further contain substances which increase the viscosity of the suspension including, for example, sodium carboxymethylcellulose, sorbitol and/or dextran. The suspension can also contain stabilizers.

C. Additional Formulations i. Emulsions

The compositions of the present invention can be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution in either aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

ii. Microemulsions

In one embodiment of the present invention, the compositions of iRNAs and nucleic acids are formulated as microemulsions. A microemulsion can be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191, 105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions can form spontaneously when their components are brought together at ambient temperature. This can be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present invention will facilitate the increased systemic absorption of iRNAs and nucleic acids from the gastrointestinal tract, as well as improve the local cellular uptake of iRNAs and nucleic acids.

Microemulsions of the present invention can also contain additional components and additives such as sorbitan monostearate (Grill 3), Labrasol, and penetration enhancers to improve the properties of the formulation and to enhance the absorption of the iRNAs and nucleic acids of the present invention. Penetration enhancers used in the microemulsions of the present invention can be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

iii. Microparticles an RNAi agent of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., Critical Reviews in Therapeutic Drug Carrier Systems, 1991, p. 92). Each of the above mentioned classes of penetration enhancers are described below in greater detail.

Surfactants (or "surface-active agents") are chemical entities which, when dissolved in an aqueous solution, reduce the surface tension of the solution or the interfacial tension between the aqueous solution and another liquid, with the result that absorption of iRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, N.Y., 2002; Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_{1-20}$ alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery, CRC Press, Danvers, Mass., 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

The physiological role of bile includes the facilitation of dispersion and absorption of lipids and fat-soluble vitamins (see e.g., Malmsten, M. Surfactants and polymers in drug delivery, Informa Health Care, New York, N.Y., 2002; Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, N.Y., 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating agents, as used in connection with the present invention, can be defined as compounds that remove metallic ions from solution by forming complexes therewith, with the result that absorption of iRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(see e.g., Katdare, A. et al., Excipient development for pharmaceutical, biotechnology, and drug delivery, CRC Press, Danvers, Mass., 2006; Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

As used herein, non-chelating non-surfactant penetration enhancing compounds can be defined as compounds that demonstrate insignificant activity as chelating agents or as surfactants but that nonetheless enhance absorption of iRNAs through the alimentary mucosa (see e.g., Muranishi, Critical Reviews in Therapeutic Drug Carrier Systems, 1990, 7, 1-33). This class of penetration enhancers includes, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of iRNAs at the cellular level can also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs. Examples of commercially available transfection reagents include, for example Lipofectamine™ (Invitrogen; Carlsbad, Calif.), Lipofectamine 2000™ (Invitrogen; Carlsbad, Calif.), 293Fectin™ (Invitrogen; Carlsbad, Calif.), Cellfectin™ (Invitrogen; Carlsbad, Calif.), DMRIE-C™ (Invitrogen; Carlsbad, Calif.), FreeStyle™ MAX (Invitrogen; Carlsbad, Calif.), Lipofectamine™ 2000 CD (Invitrogen; Carlsbad, Calif.), Lipofectamine™ (Invitrogen; Carlsbad, Calif.), RNAiMAX (Invitrogen; Carlsbad, Calif.), Oligofectamine™ (Invitrogen; Carlsbad, Calif.), Optifect™ (Invitrogen; Carlsbad, Calif.), X-tremeGENE Q2 Transfection Reagent (Roche; Grenzacherstrasse, Switzerland), DOTAP Liposomal Transfection Reagent (Grenzacherstrasse, Switzerland), DOSPER Liposomal Transfection Reagent (Grenzacherstrasse, Switzerland), or Fugene (Grenzacherstrasse, Switzerland), Transfectam® Reagent (Promega; Madison, Wis.), TransFast™ Transfection Reagent (Promega; Madison, Wis.), Tfx™-20 Reagent (Promega; Madison, Wis.), Tfx™-50 Reagent (Promega; Madison, Wis.), DreamFect™ (OZ Biosciences; Marseille, France), EcoTransfect (OZ Biosciences; Marseille, France), TransPassa D1 Transfection Reagent (New England Biolabs; Ipswich, Mass., USA), LyoVec™/LipoGen™ (Invitrogen; San Diego, Calif., USA), PerFectin Transfection Reagent (Genlantis; San Diego, Calif., USA), NeuroPORTER Transfection Reagent (Genlantis; San Diego, Calif., USA), GenePORTER Transfection reagent (Genlantis; San Diego, Calif., USA), GenePORTER 2 Transfection reagent (Genlantis; San Diego, Calif., USA), Cytofectin Transfection Reagent (Genlantis; San Diego, Calif., USA), BaculoPORTER Transfection Reagent (Genlantis; San Diego, Calif., USA), TroganPORTER™ transfection Reagent (Genlantis; San Diego, Calif., USA), RiboFect (Bioline; Taunton, Mass., USA), PlasFect (Bioline; Taunton, Mass., USA), UniFECTOR (B-Bridge International; Mountain View, Calif., USA), SureFECTOR (B-Bridge International; Mountain View, Calif., USA), or HiFect™ (B-Bridge International, Mountain View, Calif., USA), among others.

Other agents can be utilized to enhance the penetration of the administered nucleic acids, including glycols such as ethylene glycol and propylene glycol, pyrrols such as 2-pyrrol, azones, and terpenes such as limonene and menthone.

v. Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

vi. Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

vii. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions can contain substances which increase the viscosity of the suspension including, for example, sodium carboxymethylcellulose, sorbitol and/or dextran. The suspension can also contain stabilizers.

In some embodiments, pharmaceutical compositions featured in the invention include (a) one or more iRNA compounds and (b) one or more agents which function by a non-RNAi mechanism and which are useful in treating a SCAP-associated disorder. Examples of such agents include, but are not lmited to an anti-inflammatory agent, anti-steatosis agent, anti-viral, and/or anti-fibrosis agent. In addition, other substances commonly used to protect the liver, such as silymarin, can also be used in conjunction with the iRNAs described herein. Other agents useful for treating liver diseases include telbivudine, entecavir, and protease inhibitors such as telaprevir and other disclosed, for example, in Tung et al., U.S. Application Publication Nos. 2005/0148548, 2004/0167116, and 2003/0144217; and in Hale et al., U.S. Application Publication No. 2004/0127488.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the $ED_{50}$ with little or no toxicity. The dosage can vary within this range depending upon the dosage form employed and the route of administration utilized. For any compound used in the methods featured in the invention, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the $IC_{50}$ (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents effective in treatment of pathological processes mediated by SCAP expression. In any event, the administering physician can adjust the amount and timing of iRNA administration on the basis of results observed using standard measures of efficacy known in the art or described herein.

VI. Methods for Inhibiting SCAP Expression

The present invention also provides methods of inhibiting expression of a SCAP gene in a cell. The methods include contacting a cell with an RNAi agent, e.g., double stranded RNAi agent, in an amount effective to inhibit expression of SCAP in the cell, thereby inhibiting expression of SCAP in the cell. In certain embodiments of the invention, SCAP is inhibited preferentially in liver cells.

Contacting of a cell with an iRNA, e.g., a double stranded RNAi agent, may be done in vitro or in vivo. Contacting a cell in vivo with the iRNA includes contacting a cell or group of cells within a subject, e.g., a human subject, with the iRNA. Combinations of in vitro and in vivo methods of contacting a cell are also possible. Contacting a cell may be direct or indirect, as discussed above. Furthermore, contacting a cell may be accomplished via a targeting ligand, including any ligand described herein or known in the art. In some embodiments, the targeting ligand is a carbohydrate moiety, e.g., a $GalNAc_3$ ligand, or any other ligand that directs the RNAi agent to a site of interest.

The term "inhibiting," as used herein, is used interchangeably with "reducing," "silencing," "downregulating," "suppressing" and other similar terms, and includes any level of inhibition.

The phrase "inhibiting expression of a SCAP," as used herein, includes inhibition of expression of any SCAP gene (such as, e.g., a mouse SCAP gene, a rat SCAP gene, a monkey SCAP gene, or a huma SCAP gene) as well as variants or mutants of a SCAP gene that encode a SCAP protein. Thus, the SCAP gene may be a wild-type SCAP gene, a mutant SCAP gene, or a transgenic SCAP gene in the context of a genetically manipulated cell, group of cells, or organism.

"Inhibiting expression of a SCAP gene" includes any level of inhibition of a SCAP gene, e.g., at least partial suppression of the expression of a SCAP gene, such as an inhibition by at least about 20%. In certain embodiments, inhibition is by at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%.

The expression of a SCAP gene may be assessed based on the level of any variable associated with SCAP gene expression, e.g., SCAP mRNA level or SCAP protein level. The expression of a SCAP may also be assessed indirectly based on the levels of a serum lipid, a triglyceride, cholesterol (including LDL-C, HDL-C, VLDL-C, IDL-C and total cholesterol), or free fatty acids. The expression of a SCAP may also be assessed indirectly based on the level of SREPB levels and/or the PNPLA3 levels.

Inhibition may be assessed by a decrease in an absolute or relative level of one or more of these variables compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In certain embodiments, surrogate markers can be used to detect inhibition of SCAP. For example, effective treatment of a SCAP-associated disorder, e.g., a liver disorder, as demonstrated by acceptable diagnostic and monitoring criteria with an agent to reduce SCAP expression can be understood to demonstrate a clinically relevant reduction in SCAP.

In some embodiments of the methods of the invention, expression of a SCAP gene is inhibited by at least 20%, a 25%, 30%, 35%, 40%, 45%, 50%, 55%, 60%, 65%, 70%, 75%, 80%, 85%, 90%, or 95%, or to below the level of detection of the assay. In certain embodiments, the methods include a clinically relevant inhibition of expression of SCAP, e.g. as demonstrated by a clinically relevant outcome after treatment of a subject with an agent to reduce the expression of SCAP.

Inhibition of the expression of a SCAP gene may be manifested by a reduction of the amount of mRNA expressed by a first cell or group of cells (such cells may be present, for example, in a sample derived from a subject) in which a SCAP gene is transcribed and which has or have been treated (e.g., by contacting the cell or cells with an iRNA of the invention, or by administering an iRNA of the invention to a subject in which the cells are or were present) such that the expression of a SCAP gene is inhibited, as compared to a second cell or group of cells substantially identical to the first cell or group of cells but which has not or have not been so treated (control cell(s) not treated with an iRNA or not treated with an iRNA targeted to the gene of interest). The degree of inhibition may be expressed in terms of:

$$\frac{(mRNA \text{ in control cells}) - (mRNA \text{ in treated cells})}{(mRNA \text{ in control cells})} \cdot 100\%$$

In other embodiments, inhibition of the expression of a SCAP gene may be assessed in terms of a reduction of a parameter that is functionally linked to SCAP gene expression, e.g., SCAP protein expression or SCAP signaling pathways. SCAP gene silencing may be determined in any cell expressing SCAP, either endogenous or heterologous from an expression construct, and by any assay known in the art.

Inhibition of the expression of a SCAP protein may be manifested by a reduction in the level of the SCAP protein that is expressed by a cell or group of cells (e.g., the level of protein expressed in a sample derived from a subject). As explained above, for the assessment of mRNA suppression, the inhibiton of protein expression levels in a treated cell or group of cells may similarly be expressed as a percentage of the level of protein in a control cell or group of cells.

A control cell or group of cells that may be used to assess the inhibition of the expression of a SCAP gene includes a cell or group of cells that has not yet been contacted with an RNAi agent of the invention. For example, the control cell or group of cells may be derived from an individual subject (e.g., a human or animal subject) prior to treatment of the subject with an RNAi agent.

The level of SCAP mRNA that is expressed by a cell or group of cells may be determined using any method known in the art for assessing mRNA expression. In one embodiment, the level of expression of SCAP in a sample is determined by detecting a transcribed polynucleotide, or portion thereof, e.g., mRNA of the SCAP gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene (PreAnalytix, Switzerland). Typical assay formats utilizing ribonucleic acid hybridization include nuclear run-on assays, RT-PCR, RNase protection assays, northern blotting, in situ hybridization, and microarray analysis. Circulating SCAP mRNA may be detected using methods the described in PCT Publication WO2012/177906, the entire contents of which are hereby incorporated herein by reference. In some embodiments, the level of expression of SCAP is determined using a nucleic acid probe. The term "probe", as used herein, refers to any molecule that is capable of selectively binding to a specific SCAP. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses and probe arrays. One method for the determination of mRNA levels involves contacting the isolated mRNA with a nucleic acid molecule (probe) that can hybridize to SCAP mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix gene chip array. A skilled artisan can readily adapt known mRNA detection methods for use in determining the level of SCAP mRNA.

An alternative method for determining the level of expression of SCAP in a sample involves the process of nucleic acid amplification and/or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) *Proc. Natl. Acad. Sci. USA* 88:189-193), self sustained sequence replication (Guatelli et al. (1990) *Proc. Natl. Acad. Sci. USA* 87:1874-1878), transcriptional amplification system (Kwoh et al. (1989) *Proc. Natl. Acad. Sci. USA* 86:1173-1177), Q-Beta Replicase (Lizardi et al. (1988) *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of SCAP is determined by quantitative fluorogenic RT-PCR (i.e., the TaqMan™ System) or the Dual-Glo® Luciferase assay in Example 2.

The expression levels of SCAP mRNA may be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of SCAP expression level may also comprise using nucleic acid probes in solution.

In some embodiments, the level of mRNA expression is assessed using branched DNA (bDNA) assays or real time PCR (qPCR). The use of this PCR method is described and exemplified in the Examples presented herein. Such methods can also be used for the detection of SCAP nucleic acids, SREBP nucleic acids or PNPLA3 nucleic acids.

The level of SCAP protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, western blotting, radioimmunoassay (RIA), enzyme-linked immunosorbent assays (ELISAs), immunofluorescent assays, electrochemiluminescence assays, and the like. Such assays can also be used for the detection of proteins indicative of the presence or replication of SCAP proteins, SREBP protein or PNPLA3 protein.

In some embodiments, the efficacy of the methods of the invention in the treatment of a SCAP-related disease is assessed by a decrease in SCAP mRNA level (by liver biopsy).

In some embodiments of the methods of the invention, the iRNA is administered to a subject such that the iRNA is delivered to a specific site within the subject. The inhibition of expression of SCAP may be assessed using measurements of the level or change in the level of SCAP mRNA or SCAP protein in a sample derived from a specific site within the subject, e.g., the liver. In certain embodiments, the methods include a clinically relevant inhibition of expression of SCAP, e.g. as demonstrated by a clinically relevant outcome after treatment of a subject with an agent to reduce the expression of SCAP.

As used herein, the terms detecting or determining a level of an analyte are understood to mean performing the steps to determine if a material, e.g., protein, RNA, is present. As used herein, methods of detecting or determining include detection or determination of an analyte level that is below the level of detection for the method used.

VII. Methods of Treating or Preventing SCAP-Associated Diseases

The present invention also provides methods of using an iRNA of the invention and/or a composition containing an iRNA of the invention to reduce and/or inhibit SCAP expression in a cell. The methods include contacting the cell with a dsRNA of the invention and maintaining the cell for a time sufficient to obtain degradation of the mRNA transcript of a SCAPgene, thereby inhibiting expression of the SCAP gene in the cell. Reduction in gene expression can be assessed by any methods known in the art. For example, a reduction in the expression of SCAP may be determined by determining the mRNA expression level of SCAP using methods routine to one of ordinary skill in the art, e.g., Northern blotting, qRT-PCR; by determining the protein level of SCAP using methods routine to one of ordinary skill in the art, such as Western blotting, immunological techniques. A reduction in the expression of SCAP may also be assessed indirectly by measuring a decrease in biological activity of SCAP, e.g., a decrease in the level of serum lipid, triglycerides, cholesterol and/or free fatty acids, a decrease in the level of SREPB or PNPLA3.

In the methods of the invention the cell may be contacted in vitro or in vivo, i.e., the cell may be within a subject.

A cell suitable for treatment using the methods of the invention may be any cell that expresses a SCAP gene. A cell suitable for use in the methods of the invention may be a mammalian cell, e.g., a primate cell (such as a human cell or a non-human primate cell, e.g., a monkey cell or a chimpanzee cell), a non-primate cell (such as a cow cell, a pig cell, a camel cell, a llama cell, a horse cell, a goat cell, a rabbit cell, a sheep cell, a hamster, a guinea pig cell, a cat cell, a dog cell, a rat cell, a mouse cell, a lion cell, a tiger cell, a bear cell, or a buffalo cell), a bird cell (e.g., a duck cell or a goose cell), or a whale cell. In one embodiment, the cell is a human cell, e.g., a human liver cell.

SCAP expression is inhibited in the cell by at least about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or about 100%. In preferred embodiments, SCAP expression is inhibited by at least 20%.

The in vivo methods of the invention may include administering to a subject a composition containing an iRNA, where the iRNA includes a nucleotide sequence that is complementary to at least a part of an RNA transcript of the SCAP gene of the mammal to be treated. When the organism to be treated is a mammal such as a human, the composition can be administered by any means known in the art including, but not limited to oral, intraperitoneal, or parenteral routes, including intracranial (e.g., intraventricular, intraparenchymal and intrathecal), intravenous, intramuscular, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection.

In some embodiments, the administration is via a depot injection. A depot injection may release the iRNA in a consistent way over a prolonged time period. Thus, a depot injection may reduce the frequency of dosing needed to obtain a desired effect, e.g., a desired inhibition of SCAP, or a therapeutic or prophylactic effect. A depot injection may also provide more consistent serum concentrations. Depot injections may include subcutaneous injections or intramuscular injections. In preferred embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In preferred embodiments, the infusion pump is a subcutaneous infusion pump. In other embodiments, the pump is a surgically implanted pump that delivers the iRNA to the liver.

The mode of administration may be chosen based upon whether local or systemic treatment is desired and based upon the area to be treated. The route and site of administration may be chosen to enhance targeting.

In one aspect, the present invention also provides methods for inhibiting the expression of a SCAP gene in a mammal. The methods include administering to the mammal a composition comprising a dsRNA that targets a SCAP gene in a cell of the mammal and maintaining the mammal for a time sufficient to obtain degradation of the mRNA transcript of the SCAP gene, thereby inhibiting expression of the SCAP gene in the cell. Reduction in gene expression can be assessed by any methods known it the art and by methods, e.g. qRT-PCR, described herein. Reduction in protein production can be assessed by any methods known it the art and by methods, e.g. ELISA, described herein. In one embodiment, a puncture liver biopsy sample serves as the tissue material for monitoring the reduction in SCAP gene and/or protein expression.

The present invention further provides methods of treatment of a subject in need thereof. The treatment methods of the invention include administering an iRNA of the invention to a subject, e.g., a subject that would benefit from a reduction and/or inhibition of SCAP expression, in a therapeutically effective amount of an iRNA targeting a SCAP gene or a pharmaceutical composition comprising an iRNA targeting a SCAP gene.

The present invention also provides methods of decreasing plasma triglyceride levels in a subject. The methods include administering an iRNA of the invention to a subject, e.g., a subject that would benefit from a reduction and/or inhibition of SCAP expression, in a therapeutically effective amount of an iRNA targeting a SCAP gene or a pharmaceutical composition comprising an iRNA targeting a SCAP gene.

In addition, the present invention provides methods of inhibiting the progression of NAFLD in a subject, such as the progression of steatosis to NASH in a subject having steatosis or a subject at risk of developing steatosis, e.g., a subject having inusin resistance or an obese subject; or the progression of NASH to cirrhosis in a subject having NASH or a subject at risk of developing cirrhosis. The methods include administering to the subject a therapeutically effective amount of any of the dsRNAs or the pharmaceutical composition provided herein, thereby inhibiting the progeression of NAFLD in the subject.

An iRNA of the invention may be administered as a "free iRNA." A free iRNA is administered in the absence of a pharmaceutical composition. The naked iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from a reduction and/or inhibition of SCAP gene expression are those having a SCAP-associated disorder. The term "SCAP-associated disease" includes a disease, disorder or condition that would benefit from a decrease in SCAP gene expression, replication, or protein activity. Non-limiting examples of SCAP-associated diseases include, for example, fatty liver (steatosis), nonalcoholic steatohepatitis (NASH), cirrhosis of the liver, accumulation of fat in the liver, inflammation of the liver, hepatocellular necrosis, liver fibrosis, obesity, or non-alcoholic fatty liver disease (NAFLD), hyperlipidemia, hyperlipoproteinemia, hypercholesterolemia, hypertriglyceridemia, atherosclerosis, pancreatitis, non-insulin dependent diatebes mellitus, coronary heart disease, and cerebrovascular disease. In another embodiment, the SCAP-associated disease is nonalcoholic fatty liver disease (NAFLD). In another embodiment, the SCAP-associated disease is nonalcoholic steatohepatitis (NASH). In another embodiment, the SCAP-associated disease is liver cirrhosis. In another embodiment, the SCAP-associated disease is insulin resistance. In another embodiment, the SCAP-associated disease is not insulin resistance. In one embodiment, the SCAP-associated disease is obesity.

The invention further provides methods for the use of an iRNA or a pharmaceutical composition thereof, e.g., for treating a subject that would benefit from reduction and/or inhibition of SCAP expression, e.g., a subject having a SCAP-associated disorder, in combination with other pharmaceuticals and/or other therapeutic methods, e.g., with known pharmaceuticals and/or known therapeutic methods, such as, for example, those which are currently employed for treating these disorders. For example, in certain embodiments, an iRNA targeting SCAP is administered in combination with, e.g., an agent useful in treating a SCAP-associated disorder as described elsewhere herein. For example, additional agents suitable for treating a subject that would benefit from reducton in SCAP expression, e.g., a subject having a SCAP-associated disorder, may include agents that lower one or more serum lipids. Non-limiting examples of such agents may include cholesterol synthesis inhibitors, such as HMGCR inhibitors, e.g., statins. Statins may include atorvastatin (Lipitor), fluvastatin (Lescol), lovastatin (Mevacor), lovastatin extended-release (Altoprev), pitavastatin (Livalo), pravastatin (Pravachol), rosuvastatin (Crestor), and simvastatin (Zocor). Other agents useful in treating a SCAP-associated disorder may include bile sequestering agents, such as cholestyramine and other resins; VLDL secretion inhibitors, such as niacin; lipophilic antioxidants, such as Probucol; acyl-CoA cholesterol acyl transferase inhibitors; farnesoid X receptor antagonists; sterol regulatory binding protein cleavage activating protein (SCAP) activators; microsomal triglyceride transfer protein (MTP) inhibitors; ApoE-related peptide; and therapeutic antibodies against SCAP. The additional therapeutic agents may also include agents that raise high density lipoprotein (HDL), such as cholesteryl ester transfer protein (CETP) inhibitors. Furthermore, the additional therapeutic agents may also include dietary supplements, e.g., fish oil. The iRNA and additional therapeutic agents may be administered at the same time and/or in the same combination, e.g., parenterally, or the additional therapeutic agent can be administered as part of a separate composition or at separate times and/or by another method known in the art or described herein.

In one embodiment, the method includes administering a composition featured herein such that expression of the target SCAP gene is decreased, such as for about 1, 2, 3, 4, 5, 6, 7, 8, 12, 16, 18, 24 hours, 28, 32, or abour 36 hours. In one embodiment, expression of the target SCAP gene is decreased for an extended duration, e.g., at least about two, three, four days or more, e.g., about one week, two weeks, three weeks, or four weeks or longer.

Preferably, the iRNAs useful for the methods and compositions featured herein specifically target RNAs (primary or processed) of the target SCAP gene. Compositions and methods for inhibiting the expression of these genes using iRNAs can be prepared and performed as described herein.

Administration of the dsRNA according to the methods of the invention may result in a reduction of the severity, signs, symptoms, and/or markers of such diseases or disorders in a patient with a SCAP-associated disorder. By "reduction" in this context is meant a statistically significant decrease in such level. The reduction can be, for example, at least about 5%, 10%, 15%, 20%, 25%, 30%, 35%, 40%, 45%, 50%, 55%, 60%, 65%, 70%, 75%, 80%, 85%, 90%, 95%, or about 100%.

Efficacy of treatment or prevention of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. For example, efficacy of treatment of a SCAP-associated disorder may be assessed, for example, by periodic monitoring of one or more serum lipid levels. Comparisons of the later readings with the initial readings provide a physician an indication of whether the treatment is effective. It is well within the ability of one skilled in the art to monitor efficacy of treatment or prevention by measuring any one of such parameters, or any combination of parameters. In connection with the administration of an iRNA targeting SCAP or pharmaceutical composition thereof, "effective against" a SCAP-associated disorder indicates that administration in a clinically appropriate manner results in a beneficial effect for at least a statistically significant fraction of patients, such as a improvement of symptoms, a cure, a reduction in disease, extension of life, improvement in quality of life, or other effect generally recognized as positive by medical doctors familiar with treating SCAP-associated disorders and the related causes.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given iRNA drug or formulation of that drug can also be judged using an experimental animal model for the given disease as known in the art. When using an experimental animal model, efficacy of treatment is evidenced when a statistically significant reduction in a marker or symptom is observed.

Alternatively, the efficacy can be measured by a reduction in the severity of disease as determined by one skilled in the art of diagnosis based on a clinically accepted disease severity grading scale, as but one example the Child-Pugh score (sometimes the Child-Turcotte-Pugh score). Any positive change resulting in e.g., lessening of severity of disease measured using the appropriate scale, represents adequate treatment using an iRNA or iRNA formulation as described herein.

Subjects can be administered a therapeutic amount of dsRNA, such as about 0.01 mg/kg to about 200 mg/kg.

The iRNA can be administered by intravenous infusion over a period of time, on a regular basis. In certain embodiments, after an initial treatment regimen, the treatments can be administered on a less frequent basis. Administration of the iRNA can reduce SCAP levels, e.g., in a cell, tissue, blood, urine or other compartment of the patient by at least about 5%, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 39, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or at least about 99% or more. In a preferred embodiment, administration of the iRNA can reduce SCAP levels, e.g., in a cell, tissue, blood, urine or other compartment of the patient by at least 20%.

Before administration of a full dose of the iRNA, patients can be administered a smaller dose, such as a 5% infusion reaction, and monitored for adverse effects, such as an allergic reaction. In another example, the patient can be monitored for unwanted immunostimulatory effects, such as increased cytokine (e.g., TNF-alpha or INF-alpha) levels.

Alternatively, the iRNA can be administered subcutaneously, i.e., by subcutaneous injection. One or more injections may be used to deliver the desired daily dose of iRNA to a subject. The injections may be repeated over a period of time. The administration may be repeated on a regular basis. In certain embodiments, after an initial treatment regimen, the treatments can be administered on a less frequent basis. A repeat-dose regimine may include administration of a therapeutic amount of iRNA on a regular basis, such as every other day or to once a year. In certain embodiments, the iRNA is administered about once per month to about once per quarter (i.e., about once every three months).

Unless otherwise defined, all technical and scientific terms used herein have the same meaning as commonly understood by one of ordinary skill in the art to which this invention belongs. Although methods and materials similar or equivalent to those described herein can be used in the practice or testing of the iRNAs and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1. iRNA Design, Synthesis, Selection, and In Vitro Evaluation

This Example describes methods for the design, synthesis, selection, and in vitro evaluation of SCAP iRNA agents.

Source of Reagents

Where the source of a reagent is not specifically given herein, such reagent can be obtained from any supplier of reagents for molecular biology at a quality/purity standard for application in molecular biology.

Bioinformatics

A set of siRNA agents targeting the huma SCAP gene, "*Homo sapiens* SREBF chaperone" (human: NCBI refseqID NM_012235; NCBI GeneID: 22937), as well as toxicology-species SCAP orthologs (cynomolgus monkey: XM_005546963; mouse: NM_001103162; rat: NM_001100966) were designed using custom R and Python scripts. The human NM_012235 REFSEQ mRNA, version 2, has a length of 4255 bases. The rationale and method for the set of siRNA designs is as follows: the predicted efficacy for every potential 19mer siRNA from position 10 through position 4255 was determined with a linear model derived the direct measure of mRNA knockdown from more than 20,000 distinct siRNA designs targeting a large number of vertebrate genes. Subsets of the SCAP siRNAs were designed with perfect or near-perfect matches between human and cynomolgus monkey. A further subset was designed with perfect or near-perfect matches to mouse and rat SCAP orthologs. A further subset was designed with perfect or near-perfect matches to human, cynomolgus monkey and mouse SCAP orthologs. A further subset was designed with perfect or near-perfect matches to human, cynomolgus monkey, mouse, and rat SCAP orthologs. For each strand of the siRNA, a custom Python script was used in a brute force search to measure the number and positions of mismatches between the siRNA and all potential alignments in the target species transcriptome. Extra weight was given to mismatches in the seed region, defined here as positions 2-9 of the antisense oligonucleotide, as well the cleavage site of the siRNA, defined here as positions 10-11 of the antisense oligonucleotide. The relative weight of the mismatches was 2.8; 1.2:1 for seed mismatches, cleavage site, and other positions up through antisense position 19. Mismatches in the first position were ignored. A specificity score was calculated for each strand by summing the value of each weighted mismatch. Preference was given to siRNAs whose antisense score in human was >=2.2 and predicted efficacy was >=50% knockdown of the SCAP transcript.

Synthesis of SCAP Sequences

Synthesis of SCAP Single Strands and Duplexes

SCAP siRNA sequences were synthesized at 1 μmol scale on Mermade 192 synthesizer (BioAutomation) using the solid support mediated phosphoramidite chemistry. The solid support was controlled pore glass (500° A) loaded with custom GalNAc ligand or universal solid support (AM biochemical). Ancillary synthesis reagents, 2'-F and 2'-O-Methyl RNA and deoxy phosphoramidites were obtained from Thermo-Fisher (Milwaukee, Wis.) and Hongene (China). 2'F, 2'-O-Methyl, RNA, DNA and other modified nucleosides were introduced in the sequences using the corresponding phosphoramidites. Synthesis of 3' GalNAc conjugated single strands was performed on a GalNAc modified CPG support. Custom CPG universal solid support was used for the synthesis of antisense single strands. Coupling time for all phosphoramidites (100 mM in acetonitrile) was 5 minutes employing 5-Ethylthio-1H-tetrazole (ETT) as activator (0.6 M in acetonitrile). Phosphorothioate linkages were generated using a 50 mM solution of 3-((Dimethylamino-methylidene) amino)-3H-1, 2, 4-dithiazole-3-thione (DDTT, obtained from Chemgenes (Wilmington, Mass., USA) in anhydrous acetonitrile/pyridine (1:1 v/v). Oxidation time was 3 minutes. All sequences were synthesized with final removal of the DMT group ("DMT off").

Upon completion of the solid phase synthesis, single strands were cleaved from the solid support and deprotected in sealed 96 deep well plates using 200 μL Aqueous Methylamine reagent at 60° C. for 20 minutes. For sequences containing 2' ribo residues (2'-OH) that are protected with tert-butyl dimethyl silyl (TBDMS) group, a second step deprotection was performed using TEA.3HF (triethylamine trihydro fluoride) reagent. To the methylamine deprotection solution, 200 uL of dimethyl sulfoxide (DMSO) and 300 ul TEA.3HF reagent was added and the solution was incubated for additional 20 minutes at 60° C. At the end of cleavage and deprotection step, the synthesis plate was allowed to come to room temperature and was precipitated by addition of 1 mL of acetontile:ethanol mixture (9:1). The plates were cooled at −80° C. for 2 hours and the supernatant decanted carefully with the aid of a multi-channel pipette. The oligonucleotide pellet was re-suspended in 20 mM NaOAc buffer and were desalted using a 5 mL HiTrap size exclusion column (GE Healthcare) on an AKTA Purifier System equipped with an A905 autosampler and a Frac 950 fraction collector. Desalted samples were collected in 96 well plates. Samples from each sequence were analyzed by LC-MS to confirm the identity, UV (260 nm) for quantification and a selected set of samples by IEX chromatography to determine purity.

Annealing of SCAP single strands was performed on a Tecan liquid handling robot. Equimolar mixture of sense and antisense single strands were combined and annealed in 96 well plates. After combining the complementary single strands, the 96 well plate was sealed tightly and heated in an oven at 100° C. for 10 minutes and allowed to come slowly to room temperature over a period 2-3 hours. The concentration of each duplex was normalized to 10 uM in 1×PBS and then submitted for in vitro screening assays.

A detailed list of the modified SCAP sense and antisense strand sequences is shown in Table 2 and a detailed list of the unmodified SCAP sense and antisense strand sequences is shown in Table 3.

In Vitro Screening:
Cell Culture and Transfections:

Primary Mouse Hepatocytes (PMH) (GIBCO) and Primary Cyno Hepatocytes (PCH) (Celsis) were transfected by adding 4.90 of Opti-MEM plus 0.1 µl of Lipofectamine RNAiMax per well (Invitrogen, Carlsbad Calif. cat #13778-150) to 5 µl of siRNA duplexes per well into a 384-well plate and incubated at room temperature for 15 minutes. Forty µl of William's E Medium (Life Tech) containing about 5×10³ cells were then added to the siRNA mixture. Cells were incubated for 24 hours prior to RNA purification. Single dose experiments were performed at 10 nM and 0.1 nM.

Total RNA Isolation Using DYNABEADS mRNA Isolation Kit (Invitrogen, Part #: 610-12):

RNA was isolated using an automated protocol on a BioTek-EL406 platform using DYNABEADS (Invitrogen, cat #61012). Fifty µl of Lysis/Binding Buffer and 25 µl of Lysis Buffer containing 34 of magnetic beads were added to the plate with cells. Plates were incubated on an electromagnetic shaker for 10 minutes at room temperature and then magnetic beads were captured and the supernatant was removed. Bead-bound RNA was then washed 2 times with 150 µl Wash Buffer A and once with Wash Buffer B. Beads were then washed with 150 µl Elution Buffer, re-captured and supernatant was removed.

cDNA Synthesis Using ABI High Capacity cDNA Reverse Transcription Kit (Applied Biosystems, Foster City, Calif., Cat #4368813):

Ten µl of a master mix containing 1 µl 10× Buffer, 0.4 µl 25×dNTPs, 1 µl Random primers, 0.5 µl Reverse Transcriptase, 0.5 µl RNase inhibitor and 6.6 µl of H₂O per reaction were added to RNA isolated per well. Plates were sealed, mixed and incubated on an electromagnetic shaker for 10 minutes at room temperature, and then incubated at 37° C. for 2 hours. Plates were then incubated at 81° C. for 8 minutes.

Real Time PCR:

Two µl of cDNA were added to a master mix containing 0.5 µl of human GAPDH TaqMan Probe (4326317E), 0.5 µl huma SCAP (Hs00168352_m1), and 5 µl Lightcycler 480 probe master mix (Roche Cat #04887301001) per well in a 384 well plates (Roche cat #04887301001). Real time PCR was done in a LightCycler480 Real Time PCR system (Roche) using the ΔΔCt(RQ) assay. Each duplex was tested in at least two times and data were normalized to cells transfected with a non-targeting control siRNA.

To calculate relative fold change, real time data were analyzed using the ΔΔCt method and normalized to assays performed with cells transfected with a non-targeting control siRNA. The results from the assays are shown in Table 4.

TABLE 1

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
| --- | --- |
| A | Adenosine-3'-phosphate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide (G, A, C, T or U) |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methy1-5-methyluridine-3'-phosphorothioate |
| u | 2'-O-methyluridine-3'-phosphate |
| us | 2'-O-methyluridine-3'-phosphorothioate |
| s | phosphorothioate linkage |
| L96 | N-[tris(GalNAc-alkyl)-amidodecanoyl)]-4-hydroxyprolinol Hyp-(GalNAc-alkyl)3 |
| dT | 2'-deoxythymidine-3'-phosphate |
| dC | 2'-deoxycytidine-3'-phosphate |
| P | Phosphate |
| VP | Vinyl-phosphate |

TABLE 2

SCAP Modified Sequences

| Duplex Name | Sense Sequence (5' to 3') | SEQ ID NO | Antisense Sequence (5' to 3') |
|---|---|---|---|
| AD-68570 | usgsgcaaCfaAfGfGfugacuuagcaL96 | 31 | usGfscuaAfgUfCfaccuUfgUfugccasusc |
| AD-68572 | cscscugaCfuGfAfAfaggcuucguaL96 | 34 | usAfscgaAfgCfCfuuucAfgUfcagggsusc |
| AD-68565 | gsgscuucGfuGfAfGfaagauaucuaL96 | 37 | usAfsgauAfuCfUfucucAfcGfaagccsusu |
| AD-68552 | usgsgcagCfaAfGfGfugacuucgaL96 | 40 | usCfscgaAfgUfCfaccuUfgCfugccasusc |
| AD-68533 | asusgaccCfuGfAfCfugaaaggcuaL96 | 43 | usAfsgccUfuUfCfagucAfgGfgucauscsc |
| AD-68543 | asgsgaacAfgGfAfCfcuguggaauuL96 | 46 | asAfsuucCfaCfAfggucCfuGfuuccusgsg |
| AD-68541 | gsusccagCfaGfAfUfauuugugaaaL96 | 49 | usUfsucaCfaAfAfuaucUfgCfuggacsasu |
| AD-68555 | csasguagAfuGfUfAfuuucguucaaL96 | 52 | usUfsgaaCfgAfAfauacAfuCfuacugscsc |
| AD-68540 | csascgugCfuGfAfGfagacagcucuL96 | 55 | asGfsagcUfgUfCfucucAfgCfacgugsgsu |
| AD-68551 | ususccauGfcUfGfAfuccugacauaL96 | 58 | usAfsuguCfaGfGfaucaGfcAfuggaasgsc |
| AD-68549 | csasccagGfaAfGfAfggauggucuaL96 | 61 | usAfsgacCfaUfCfucuUfcCfuggugsusa |
| AD-68542 | csasggaaGfaGfGfAfuggucuccuaL96 | 64 | usAfsggaGfaCfCfauccUfcUfuccugsgsu |
| AD-68529 | asuscaucUfuGfUfUfugccuacauaL96 | 67 | usAfsuguAfgGfCfaaacAfaGfaugausgsu |
| AD-68536 | csasucuuGfuUfUfGfccuacaucuaL96 | 70 | usAfsgauGfuAfGfgcaaAfcAfagaugsasu |
| AD-68539 | uscsuuguUfuGfCfCfuacaucuacuL96 | 73 | asGfsuagAfuGfUfaggcAfaAfcaagasusg |
| AD-68530 | gsasagauCfgAfCfAfuggucaaguaL96 | 76 | usAfscuuGfaCfCfauguCfgAfucuucscsg |
| AD-68569 | gscsucacCfaAfGfUfcaguggauaaL96 | 79 | usAfsuacCfaCfUfgacuUfgGfugagcsasc |
| AD-68564 | csasccaaGfuCfAfGfugguaucaaaL96 | 82 | usUfsugaUfaCfCfacugAfcUfuggugsasg |
| AD-68547 | csuscaauGfgCfGfGfcgagauuuuaL96 | 85 | usAfsaaaUfcUfCfgccgCfcAfuugagsgsg |
| AD-68548 | usasccuuGfuGfGfUfgguuauuggaL96 | 88 | usCfscaaUfaAfCfcaccAfcAfagguasgsg |
| AD-68544 | usgsguuaUfuGfGfGfuuuagagaauaL96 | 91 | usAfsuucUfcUfAfacccAfaUfaaccascsc |
| AD-68557 | gsusuauuGfgGfUfUfagagaaugaL96 | 94 | usAfscauUfcUfCfuaacCfcAfauaacscsa |
| AD-68535 | gsusuagaGfaAfUfGfuguuggugcuL96 | 97 | asGfscacCfaAfCfacauUfcUfcuaacscsc |
| AD-68567 | csusgacuGfaAfAfGfgcuucgugaaL96 | 100 | usUfscacGfaAfGfccuuUfcAfgucagsgsg |
| AD-68538 | asescguuGfuCfUfGfgauuggcauaL96 | 103 | usAfsugcCfaAfUfccagAfcAfacggusgsc |
| AD-68532 | ascsuuugGfaGfGfAfaauugccuuL96 | 106 | asAfsggaCfaAfUfuuccUfcCfaaagususc |
| AD-68528 | ususuggaGfgAfAfAfuugccuucaL96 | 109 | usGfsaagGfaCfAfauuuCfcUfccaaasgsu |
| AD-68553 | gsgsagagCfuGfGfGfaacgacuuuaL96 | 112 | usAfsaagUfcGfUfucccAfgCfucuccsusg |
| AD-68554 | asgscuggGfaAfCfGfacuuucagauL96 | 115 | asUfscugAfaAfGfucguUfcCfcagcuscsu |
| AD-68545 | csgsacuuUfcAfGfAfugguggaaaaL96 | 118 | usUfsuccCfaCfCfaucuGfaAfagucgsusu |
| AD-68550 | ascscugcUfuAfAfUfugacaccaaaL96 | 121 | usUfsuggUfgUfCfaauuAfaGfcaggusgsa |
| AD-68546 | gscsuuaaUfuGfAfCfaccaacuuuuL96 | 124 | asAfsaagUfuGfGfugucAfaUfuaagcsasg |
| AD-68571 | gsgsgagcCfaAfGfAfccauacucuaL96 | 127 | usAfsgagUfaUfGfgucuUfgGfcucccsusg |
| AD-68556 | ascsccauCfaCfAfGfcccugaaagaL96 | 130 | usCfsuuuCfaGfGfgcugUfgAfugggususu |
| AD-68568 | ascsagcuGfuGfUfAfcauugaucaaL96 | 133 | usUfsgauCfaAfUfguacAfcAfgcugusgsa |
| AD-68563 | asgscuguGfuAfCfAfuugaucagaaL96 | 136 | usUfscugAfuCfAfauguAfcAfcagcusgsu |
| AD-68560 | csusgccuGfuGfGfGfauguacuaaaL96 | 139 | usUfsuagUfaCfAfucccAfcAfggcagsasu |

TABLE 2-continued

SCAP Modified Sequences

| | | | | |
|---|---|---|---|---|
| AD-68562 | asgsuggcCfuGfGfAfugacuucauaL96 | 142 | usAfsugaAfgUfCfauccAfgGfccacusasc | |
| AD-68559 | csusccuuUfuGfGfGfaccuaaacuaL96 | 145 | usAfsguuUfaGfGfucccAfaAfaggagsasc | |
| AD-68561 | cscsuuuuGfgGfAfCfcuaaacuauaL96 | 148 | usAfsuagUfuUfAfggucCfcAfaaaggsasg | |
| AD-68558 | asasgcuuGfgGfUfGfucaucucagaL96 | 151 | usCfsugaGfaUfGfacacCfcAfagcuusgsc | |
| AD-68531 | asgsgcuGfuGfUfCfuccuuuuggaL96 | 154 | usCfscaaAfaGfGfagacAfcAfgcccusgsg | |
| AD-68537 | gscsugccAfuUfGfUfcugcaacuuuL96 | 157 | asAfsaguUfgCfAfgacaAfuGfgcagcsgsu | |
| AD-68527 | csusgccaUfuGfUfCfugcaacuuuaL96 | 160 | usAfsaagUfuGfCfagacAfaUfggcagscsg | |
| AD-68534 | asascuuuGfgCfAfGfugagcucagaL96 | 163 | usCfsugaGfcUfCfacugCfcAfaaguusgsc | |
| AD-68566 | uscsuccuGfaCfUfGfuaauaauaaaL96 | 166 | usUfsuauUfaUfUfacagUfcAfggagascsa | |

| Duplex Name | SEQ ID NO | mRNA target sequence | SEQ ID NO |
|---|---|---|---|
| AD-68570 | 32 | GAUGGCAACAAGGUGACUUAGCC | 33 |
| AD-68572 | 35 | GACCCUGACUGAAAGGCUUCGUG | 36 |
| AD-68565 | 38 | AAGGCUUCGUGAGAAGAUAUCUC | 39 |
| AD-68552 | 41 | GAUGGCAGCAAGGUGACUUCGGC | 42 |
| AD-68533 | 44 | GGAUGACCCUGACUGAAAGGCUG | 45 |
| AD-68543 | 47 | CCAGGAACAGGACCUGUGGAAUU | 48 |
| AD-68541 | 50 | AUGUCCAGCAGAUAUUUGUGAAG | 51 |
| AD-68555 | 53 | GGCAGUAGAUGUAUUUCGUUCAC | 54 |
| AD-68540 | 56 | ACCACGUGCUGAGAGACAGCUCU | 57 |
| AD-68551 | 59 | GCUUCCAUGCUGAUCCUGACAUC | 60 |
| AD-68549 | 62 | UACACCAGGAAGAGGAUGGUCUC | 63 |
| AD-68542 | 65 | ACCAGGAAGAGGAUGGUCUCCUA | 66 |
| AD-68529 | 68 | ACAUCAUCUUGUUUGCCUACAUC | 69 |
| AD-68536 | 71 | AUCAUCUUGUUUGCCUACAUCUA | 72 |
| AD-68539 | 74 | CAUCUUGUUUGCCUACAUCUACU | 75 |
| AD-68530 | 77 | CGGAAGAUCGACAUGGUCAAGUC | 78 |
| AD-68569 | 80 | GUGCUCACCAAGUCAGUGGUAUC | 81 |
| AD-68564 | 83 | CUCACCAAGUCAGUGGUAUCAAC | 84 |
| AD-68547 | 86 | CCCUCAAUGGCGGCGAGAUUUUC | 87 |
| AD-68548 | 89 | CCUACCUUGUGGUGGUUAUUGGG | 90 |
| AD-68544 | 92 | GGUGGUUAUUGGGUUAGAGAAUG | 93 |
| AD-68557 | 95 | UGGUUAUUGGGUUAGAGAAUGUG | 96 |
| AD-68535 | 98 | GGGUUAGAGAAUGUGUUGGUGCU | 99 |
| AD-68567 | 101 | CCCUGACUGAAAGGCUUCGUGAG | 102 |
| AD-68538 | 104 | GCACCGUUGUCUGGAUUGGCAUC | 105 |
| AD-68532 | 107 | GAACUUUGGAGGAAAUUGUCCUU | 108 |
| AD-68528 | 110 | ACUUUGGAGGAAAUUGUCCUUCC | 111 |
| AD-68553 | 113 | CAGGAGAGCUGGGAACGACUUUC | 114 |

TABLE 2-continued

SCAP Modified Sequences

| | | | |
|---|---|---|---|
| AD-68554 | 116 | AGAGCUGGGAACGACUUUCAGAU | 117 |
| AD-68545 | 119 | AACGACUUUCAGAUGGUGGGAAG | 120 |
| AD-68550 | 122 | UCACCUGCUUAAUUGACACCAAC | 123 |
| AD-68546 | 125 | CUGCUUAAUUGACACCAACUUUU | 126 |
| AD-68571 | 128 | CAGGGAGCCAAGACCAUACUCUA | 129 |
| AD-68556 | 131 | AAACCCAUCACAGCCCUGAAAGC | 132 |
| AD-68568 | 134 | UCACAGCUGUGUACAUUGAUCAG | 135 |
| AD-68563 | 137 | ACAGCUGUGUACAUUGAUCAGAC | 138 |
| AD-68560 | 140 | AUCUGCCUGUGGGAUGUACUAAC | 141 |
| AD-68562 | 143 | GUAGUGGCCUGGAUGACUUCAUC | 144 |
| AD-68559 | 146 | GUCUCCUUUUGGGACCUAAACUA | 147 |
| AD-68561 | 149 | CUCCUUUUGGGACCUAAACUAUG | 150 |
| AD-68558 | 152 | GCAAGCUUGGGUGUCAUCUCAGA | 153 |
| AD-68531 | 155 | CCAGGGCUGUGUCUCCUUUUGGG | 156 |
| AD-68537 | 158 | ACGCUGCCAUUGUCUGCAACUUU | 159 |
| AD-68527 | 161 | CGCUGCCAUUGUCUGCAACUUUG | 162 |
| AD-68534 | 164 | GCAACUUUGGCAGUGAGCUCAGC | 165 |
| AD-68566 | 167 | UGUCUCCUGACUGUAAUAAUAAA | 168 |

TABLE 3

SCAP Unmodified Sequences

| Duplex Name | Sense Sequence (5' to 3') | SEQ ID NO | Position in NM_012235.2 | Antisense Sequence (5' to 3') | SEQ ID NO |
|---|---|---|---|---|---|
| AD-68570 | UGGCAACAAGGUGACUUAGCA | 169 | 135-155 | UGCUAAGUCACCUUGUUGCCAUC | 170 |
| AD-68572 | CCCUGACUGAAAGGCUUCGUA | 171 | 164-184 | UACGAAGCCUUUCAGUCAGGGUC | 172 |
| AD-68565 | GGCUUCGUGAGAAGAUAUCUA | 173 | 176-196 | UAGAUAUCUUCUCACGAAGCCUU | 174 |
| AD-68552 | UGGCAGCAAGGUGACUUCGGA | 175 | 230-250 | UCCGAAGUCACCUUGCUGCCAUC | 176 |
| AD-68533 | AUGACCCUGACUGAAAGGCUA | 177 | 256-276 | UAGCCUUUCAGUCAGGGUCAUCC | 178 |
| AD-68543 | AGGAACAGGACCUGUGGAAUU | 179 | 405-425 | AAUUCCACAGGUCCUGUUCCUGG | 180 |
| AD-68541 | GUCCAGCAGAUAUUUGUGAAA | 181 | 532-552 | UUUCACAAAUAUCUGCUGGACAU | 182 |
| AD-68555 | CAGUAGAUGUAUUUCGUUCAA | 183 | 587-607 | UUGAACGAAAUACAUCUACUGCC | 184 |
| AD-68540 | CACGUGCUGAGAGACAGCUCU | 185 | 649-669 | AGAGCUGUCUCUCAGCACGUGGU | 186 |
| AD-68551 | UUCCAUGCUGAUCCUGACAUA | 187 | 808-828 | UAUGUCAGGAUCAGCAUGGAAGC | 188 |
| AD-68549 | CACCAGGAAGAGGAUGGUCUA | 189 | 933-953 | UAGACCAUCCUCUUCCUGGUGUA | 190 |
| AD-68542 | CAGGAAGAGGAUGGUCUCCUA | 191 | 936-956 | UAGGAGACCAUCCUCUUCCUGGU | 192 |
| AD-68529 | AUCAUCUUGUUUGCCUACAUA | 193 | 1132-1152 | UAUGUAGGCAAACAAGAUGAUGU | 194 |
| AD-68536 | CAUCUUGUUUGCCUACAUCUA | 195 | 1134-1154 | UAGAUGUAGGCAAACAAGAUGAU | 196 |
| AD-68539 | UCUUGUUUGCCUACAUCUACU | 197 | 1136-1156 | AGUAGAUGUAGGCAAACAAGAUG | 198 |
| AD-68530 | GAAGAUCGACAUGGUCAAGUA | 199 | 1167-1187 | UACUUGACCAUGUCGAUCUUCCG | 200 |

TABLE 3-continued

SCAP Unmodified Sequences

| Duplex Name | Sense Sequence (5' to 3') | SEQ ID NO | Position in NM_012235.2 | Antisense Sequence (5' to 3') | SEQ ID NO |
|---|---|---|---|---|---|
| AD-68569 | GCUCACCAAGUCAGUGGUAUA | 201 | 1248-1268 | UAUACCACUGACUUGGUGAGCAC | 202 |
| AD-68564 | CACCAAGUCAGUGGUAUCAAA | 203 | 1251-1271 | UUUGAUACCACUGACUUGGUGAG | 204 |
| AD-68547 | CUCAAUGGCGGCGAGAUUUUA | 205 | 1282-1302 | UAAAAUCUCGCCGCCAUUGAGGG | 206 |
| AD-68548 | UACCUUGUGGUGGUUAUUGGA | 207 | 1306-1326 | UCCAAUAACCACCACAAGGUAGG | 208 |
| AD-68544 | UGGUUAUUGGGUUAGAGAAUA | 209 | 1316-1336 | UAUUCUCUAACCCAAUAACCACC | 210 |
| AD-68557 | GUUAUUGGGUUAGAGAAUGUA | 211 | 1318-1338 | UACAUUCUCUAACCCAAUAACCA | 212 |
| AD-68535 | GUUAGAGAAUGUGUUUGGUGCU | 213 | 1326-1346 | AGCACCAACACAUUCUCUAACCC | 214 |
| AD-68567 | CUGACUGAAAGGCUUCGUGAA | 215 | 166-186 | UUCACGAAGCCUUUCAGUCAGGG | 216 |
| AD-68538 | ACCGUUGUCUGGAUUGGCAUA | 217 | 1825-1845 | UAUGCCAAUCCAGACAACGGUGC | 218 |
| AD-68532 | ACUUUGGAGGAAAUUGUCCUU | 219 | 2124-2144 | AAGGACAAUUUCCUCCAAAGUUC | 220 |
| AD-68528 | UUUGGAGGAAAUUGUCCUUCA | 221 | 2126-2146 | UGAAGGACAAUUUCCUCCAAAGU | 222 |
| AD-68553 | GGAGAGCUGGGAACGACUUUA | 223 | 2748-2768 | UAAAGUCGUUCCCAGCUCUCCUG | 224 |
| AD-68554 | AGCUGGGAACGACUUUCAGAU | 225 | 2752-2772 | AUCUGAAAGUCGUUCCCAGCUCU | 226 |
| AD-68545 | CGACUUUCAGAUGGUGGGAAA | 227 | 2761-2781 | UUUCCCACCAUCUGAAAGUCGUU | 228 |
| AD-68550 | ACCUGCUUAAUUGACACCAAA | 229 | 2875-2895 | UUUGGUGUCAAUUAAGCAGGUGA | 230 |
| AD-68546 | GCUUAAUUGACACCAACUUUU | 231 | 2879-2899 | AAAAGUUGGUGUCAAUUAAGCAG | 232 |
| AD-68571 | GGGAGCCAAGACCAUACUCUA | 233 | 3433-3453 | UAGAGUAUGGUCUUGGCUCCCUG | 234 |
| AD-68556 | ACCCAUCACAGCCCUGAAAGA | 235 | 3495-3515 | UCUUUCAGGGCUGUGAUGGGUUU | 236 |
| AD-68568 | ACAGCUGUGUACAUUGAUCAA | 237 | 3517-3537 | UUGAUCAAUGUACACAGCUGUGA | 238 |
| AD-68563 | AGCUGUGUACAUUGAUCAGAA | 239 | 3519-3539 | UUCUGAUCAAUGUACACAGCUGU | 240 |
| AD-68560 | CUGCCUGUGGGAUGUACUAAA | 241 | 3576-3596 | UUUAGUACAUCCCACAGGCAGAU | 242 |
| AD-68562 | AGUGGCCUGGAUGACUUCAUA | 243 | 3676-3696 | UAUGAAGUCAUCCAGGCCACUAC | 244 |
| AD-68559 | CUCCUUUUGGGACCUAAACUA | 245 | 3816-3836 | UAGUUUAGGUCCCAAAAGGAGAC | 246 |
| AD-68561 | CCUUUUGGGACCUAAACUAUA | 247 | 3818-3838 | UAUAGUUUAGGUCCCAAAAGGAG | 248 |
| AD-68558 | AAGCUUGGGUGUCAUCUCAGA | 249 | 3867-3887 | UCUGAGAUGACACCCAAGCUUGC | 250 |
| AD-68531 | AGGGCUGUGUCUCCUUUUGGA | 251 | 3911-3931 | UCCAAAAGGAGACACAGCCCUGG | 252 |
| AD-68537 | GCUGCCAUUGUCUGCAACUUU | 253 | 4021-4041 | AAAGUUGCAGACAAUGGCAGCGU | 254 |
| AD-68527 | CUGCCAUUGUCUGCAACUUUA | 255 | 4022-4042 | UAAAGUUGCAGACAAUGGCAGCG | 256 |
| AD-68534 | AACUUGGCAGUGAGCUCAGA | 257 | 4036-4056 | UCUGAGCUCACUGCCAAAGUUGC | 258 |
| AD-68566 | UCUCCUGACUGUAAUAAUAAA | 259 | 4097-4117 | UUUAUUAUUACAGUCAGGAGACA | 260 |

TABLE 4

SCAP Single Dose Screen in Primary Mouse and Primary Cyno Hepatocytes Data are expressed as percent message remaining relative to AD-1955 non-targeting control.

| | Primary Mouse Hepatocytes | | | | Primary Cyno Hepatocytes | | | |
|---|---|---|---|---|---|---|---|---|
| DuplexID | 10 nM Avg | 10 nM SD | 0.1 nM Avg | 0.1 nM SD | 10 nM Avg | 10 nM SD | 0.1 nM Avg | 0.1 nM SD |
| AD-68570.1 | 41.7 | 4.9 | 99.7 | 4.7 | 80.9 | 9.5 | 100.6 | 8.1 |
| AD-68572.1 | 35.3 | 4.7 | 89.7 | 6.0 | 45.7 | 5.3 | 89.0 | 6.4 |
| AD-68565.1 | 28.2 | 5.2 | 88.8 | 11.2 | 34.5 | 3.5 | 62.3 | 5.1 |
| AD-68552.1 | 111.9 | 29.8 | 119.5 | 13.4 | 39.0 | 4.5 | 91.6 | 4.4 |
| AD-68533.1 | 30.1 | 7.2 | 60.7 | 6.1 | 34.6 | 5.7 | 80.5 | 7.5 |
| AD-68543.1 | 72.9 | 17.4 | 94.1 | 13.6 | 32.9 | 5.4 | 60.8 | 6.5 |
| AD-68541.1 | 42.0 | 5.5 | 71.0 | 9.9 | 20.6 | 2.7 | 44.3 | 2.9 |
| AD-68555.1 | 102.9 | 16.9 | 106.4 | 5.5 | 20.2 | 3.4 | 46.2 | 6.1 |
| AD-68540.1 | 50.6 | 7.6 | 73.0 | 4.2 | 42.0 | 5.1 | 83.7 | 3.2 |
| AD-68551.1 | 93.4 | 13.0 | 96.2 | 6.1 | 26.1 | 2.2 | 44.5 | 7.2 |
| AD-68549.1 | 74.1 | 4.2 | 83.1 | 6.6 | 42.2 | 7.1 | 88.8 | 7.4 |
| AD-68542.1 | 23.3 | 7.2 | 59.8 | 4.5 | 30.3 | 2.7 | 76.4 | 13.6 |
| AD-68529.1 | 14.7 | 2.3 | 29.5 | 6.1 | 18.4 | 1.4 | 34.6 | 9.2 |
| AD-68536.1 | 15.0 | 2.4 | 71.4 | 2.9 | 22.8 | 3.8 | 50.7 | 3.1 |
| AD-68539.1 | 14.7 | 1.9 | 50.1 | 5.2 | 19.0 | 2.5 | 41.6 | 3.2 |
| AD-68530.1 | 38.5 | 4.9 | 79.0 | 10.4 | 48.1 | 4.9 | 90.4 | 10.2 |
| AD-68569.1 | 32.5 | 3.7 | 102.4 | 11.5 | 72.1 | 5.7 | 100.4 | 5.5 |
| AD-68564.1 | 13.4 | 5.5 | 44.0 | 3.7 | 84.8 | 12.1 | 94.6 | 4.2 |
| AD-68547.1 | 99.5 | 18.2 | 89.5 | 8.8 | 37.5 | 3.9 | 85.4 | 5.4 |
| AD-68548.1 | 100.3 | 10.3 | 89.5 | 2.2 | 58.2 | 7.7 | 93.5 | 5.0 |
| AD-68544.1 | 69.5 | 8.7 | 98.0 | 2.3 | 20.8 | 3.5 | 60.8 | 7.8 |
| AD-68557.1 | 114.6 | 14.3 | 93.9 | 5.8 | 48.2 | 8.9 | 93.9 | 0.7 |
| AD-68535.1 | 80.0 | 7.3 | 87.0 | 14.9 | 30.1 | 3.7 | 88.6 | 3.4 |
| AD-68567.1 | 34.3 | 14.6 | 73.6 | 39.9 | 66.3 | 18.3 | 94.2 | 4.6 |
| AD-68538.1 | 32.9 | 3.8 | 80.1 | 12.8 | 30.0 | 3.2 | 71.8 | 3.9 |
| AD-68532.1 | 37.8 | 11.7 | 70.8 | 6.2 | 24.5 | 1.5 | 59.5 | 9.0 |
| AD-68528.1 | 50.5 | 7.0 | 81.6 | 8.4 | 28.9 | 1.9 | 73.2 | 6.8 |
| AD-68553.1 | 104.7 | 12.4 | 108.3 | 12.8 | 29.3 | 4.8 | 52.9 | 6.6 |
| AD-68554.1 | 103.5 | 16.7 | 107.4 | 7.7 | 33.6 | 4.6 | 86.9 | 3.5 |
| AD-68545.1 | 130.1 | 23.3 | 112.8 | 9.1 | 45.9 | 2.2 | 97.8 | 9.3 |
| AD-68550.1 | 20.7 | 1.7 | 67.0 | 10.2 | 17.0 | 4.4 | 62.0 | 13.8 |
| AD-68546.1 | 41.0 | 3.1 | 99.4 | 7.7 | 19.1 | 2.2 | 49.1 | 1.3 |
| AD-68571.1 | 17.9 | 0.7 | 89.0 | 4.2 | 76.1 | 6.7 | 100.3 | 9.0 |
| AD-68556.1 | 102.1 | 13.1 | 100.4 | 8.2 | 65.4 | 6.6 | 95.1 | 9.7 |
| AD-68568.1 | 15.1 | 2.2 | 49.4 | 5.1 | 94.4 | 8.9 | 100.3 | 5.6 |
| AD-68563.1 | 12.2 | 1.6 | 65.1 | 6.6 | 44.3 | 4.8 | 91.1 | 4.8 |
| AD-68560.1 | 26.4 | 3.7 | 75.7 | 15.1 | 37.1 | 2.4 | 78.4 | 1.8 |
| AD-68562.1 | 29.8 | 5.9 | 82.9 | 9.4 | 81.7 | 7.4 | 89.9 | 7.3 |
| AD-68559.1 | 14.4 | 5.7 | 50.4 | 5.7 | 30.3 | 4.0 | 50.5 | 4.2 |
| AD-68561.1 | 14.2 | 0.6 | 67.8 | 6.4 | 33.0 | 3.0 | 62.9 | 3.7 |
| AD-68558.1 | 42.8 | 7.9 | 77.4 | 10.1 | 43.7 | 0.2 | 94.8 | 25.0 |
| AD-68531.1 | 31.3 | 6.1 | 77.0 | 11.8 | 47.9 | 7.2 | 85.7 | 7.1 |
| AD-68537.1 | 21.8 | 2.0 | 74.4 | 8.6 | 34.6 | 3.4 | 76.6 | 2.5 |
| AD-68527.1 | 24.1 | 9.1 | 48.0 | 10.6 | 34.4 | 4.8 | 62.2 | 4.3 |
| AD-68534.1 | 16.0 | 3.2 | 48.1 | 4.4 | 50.0 | 8.4 | 98.6 | 18.3 |
| AD-68566.1 | 6.2 | 0.7 | 20.2 | 3.1 | 40.6 | 13.8 | 67.0 | 25.6 |
| AD-1955 | 101.4 | 10.8 | 101.3 | 7.4 | 96.4 | 4.1 | 99.3 | 3.5 |

Example 2. Design, Synthesis, Selection, and In Vitro Evaluation of Additional iRNA Agents This Example describes methods for the design, synthesis, selection, and in vitro evaluation of additional SCAP iRNA agents.

Bioinformatics

A set of additional siRNAs targeting human SCAP, "Homo sapiens SREBF chaperone" (human: NCBI refseqID NM_012235; NCBI GeneID: 22937) were designed using custom R and Python scripts. The human SCAP REFSEQ mRNA has a length of 4268 bases.

A detailed list of the additional modified SCAP sense and antisense strand sequences is shown in Table 5 and a detailed list of the additional unmodified SCAP sense and antisense strand sequences is shown in Table 6.

In Vitro Hep3b Screening

Cell Culture and Transfections

Hep3b cells (ATCC) were transfected by adding 4.9 µl of Opti-MEM and 0.1 µl of Lipofectamine RNAiMax per well (Invitrogen, Carlsbad Calif. cat #13778-150) to 5 µl of siRNA duplexes per well into a 384-well plate and incubated at room temperature for 15 minutes. 40 µl of William's E Medium (Life Tech) containing ~5×10$^3$ cells were then added to the siRNA mixture. Cells were incubated for 24 hours prior to RNA purification. Single dose experiments were performed at 10 nM.

Isolation of total RNA, cDNA synthesis, and Real time PCR were performed using the methods described for Example 1 above. The results from this single dose screen are shown in Table 7.

TABLE 5

SCAP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-77471 | UCAUCUGUCAGGCACUUUAdTdT | 261 | UAAAGUGCCUGACAGAUGAdTdT | 262 | UCAUCUGUCAGGCACUUUG | 263 |
| AD-77472 | UUAAAAAACCAUAUCAUCAdTdT | 264 | UGAUGAUAUGGUUUUUUAAdTdT | 265 | UUAAAAAACCAUAUCAUCA | 266 |
| AD-77473 | AAUAAUAUUAAACUUUUUUdTdT | 267 | AAAAAGUUUAAUAUUAUUdTdT | 268 | AAUAAUAUUAAACUUUUUU | 269 |
| AD-77474 | CGCUGCCUCCUGACUGUAAdTdT | 270 | UUACAGUCAGGAGGCAGCGdTdT | 271 | CGCUGCCUCCUGACUGUAA | 272 |
| AD-77475 | AGUAUCUUCCAGCCGCUGAdTdT | 273 | UCAGCGGCUGGAAGAUACUdTdT | 274 | AGUAUCUUCCAGCCGCUGC | 275 |
| AD-77476 | UUGGGGGAAAGAGCCGAGUdTdT | 276 | ACUCGGCUCUUUCCCCCAAdTdT | 277 | UUGGGGGAAAGAGCCGAGU | 278 |
| AD-77477 | CAAUGCACUGAACCUGGAAdTdT | 279 | UUCCAGGUUCAGUGCAUUGdTdT | 280 | CAAUGCACUGAACCUGGAC | 281 |
| AD-77478 | GGGCCAAUGCACUGAACCUdTdT | 282 | AGGUUCAGUGCAUUGGCCCdTdT | 283 | GGGCCAAUGCACUGAACCU | 284 |
| AD-77479 | CUGGGGUGCUGUGUGGGGAdTdT | 285 | UCCCCACACAGCACCCCAGdTdT | 286 | CUGGGGUGCUGUGUGGGGG | 287 |
| AD-77480 | UUGCCCAGGCAGGAGGCUAdTdT | 288 | UAGCCUCCUGCCUGGGCAAdTdT | 289 | UUGCCCAGGCAGGAGGCUG | 290 |
| AD-77481 | CCUCCUUGCCCAGGCAGGAdTdT | 291 | UCCUGCCUGGGCAAGGAGGdTdT | 292 | CCUCCUUGCCCAGGCAGGA | 293 |
| AD-77482 | UGGACUGAGCGCAGGGCCUdTdT | 294 | AGGCCCUGCGCUCAGUCCAdTdT | 295 | UGGACUGAGCGCAGGGCCU | 296 |
| AD-77483 | CUCUGUGCUGGAGAAGCUAdTdT | 297 | UAGCUUCUCCAGCACAGAGdTdT | 298 | CUCUGUGCUGGAGAAGCUG | 299 |
| AD-77484 | UGCCAUUGUCUGCAACUUUdTdT | 300 | AAAGUUGCAGACAAUGGCAdTdT | 301 | UGCCAUUGUCUGCAACUUU | 302 |
| AD-77485 | CUGGUGCUGGACAACGCUAdTdT | 303 | UAGCGUUGUCCAGCACCAGdTdT | 304 | CUGGUGCUGGACAACGCUG | 305 |
| AD-77486 | GCCAGAUCCUGGUGCUGGAdTdT | 306 | UCCAGCACCAGGAUCUGGCdTdT | 307 | GCCAGAUCCUGGUGCUGGA | 308 |
| AD-77487 | GAGGCCCAGCCUGCCCGCAdTdT | 309 | UGCGGGCAGGCUGGGCCUCdTdT | 310 | GAGGCCCAGCCUGCCCGCC | 311 |
| AD-77488 | CCUGGGGAAGAACAGUGAAdTdT | 312 | UUCACUGUUCUUCCCCAGGdTdT | 313 | CCUGGGGAAGAACAGUGAG | 314 |
| AD-77489 | UGUUACAGACAGUCUACCUdTdT | 315 | AGGUAGACUGUCUGUAACAdTdT | 316 | UGUUACAGACAGUCUACCU | 317 |
| AD-77490 | GUGUCUCCUUUUGGGACCUdTdT | 318 | AGGUCCCAAAAGGAGACACdTdT | 319 | GUGUCUCCUUUUGGGACCU | 320 |
| AD-77491 | GACUGGCGGCCAGGGCUGUdTdT | 321 | ACAGCCCUGGCCGCCAGUCdTdT | 322 | GACUGGCGGCCAGGGCUGU | 323 |
| AD-77492 | ACAACCUGCUGGUGACUGAdTdT | 324 | UCAGUCACCAGCAGGUUGUdTdT | 325 | ACAACCUGCUGGUGACUGG | 326 |
| AD-77493 | UUGGGUGUCAUCUCAGACAdTdT | 327 | UGUCUGAGAUGACACCCAAdTdT | 328 | UUGGGUGUCAUCUCAGACA | 329 |
| AD-77494 | AAGCUUGGGUGUCAUCUCAdTdT | 330 | UGAGAUGACACCCAAGCUUdTdT | 331 | AAGCUUGGGUGUCAUCUCA | 332 |
| AD-77495 | ACCUGGGCUGUGGUGCAAAdTdT | 333 | UUUGCACCACAGCCCAGGUdTdT | 334 | ACCUGGGCUGUGGUGCAAG | 335 |
| AD-77496 | GCACAGGCAUCAAGUUCUAdTdT | 336 | UAGAACUUGAUGCCUGUGCdTdT | 337 | GCACAGGCAUCAAGUUCUA | 338 |
| AD-77497 | CAGCAUCUGGGACCGCAGAdTdT | 339 | UCUGCGGUCCCAGAUGCUGdTdT | 340 | CAGCAUCUGGGACCGCAGC | 341 |
| AD-77498 | GGCCUGGAUGACCUCAUCAdTdT | 342 | UGAUGAGGUCAUCCAGGCCdTdT | 343 | GGCCUGGAUGACCUCAUCA | 344 |
| AD-77499 | CCUGUGUCAUCAGCAGUGAdTdT | 345 | UCACUGCUGAUGACACAGGdTdT | 346 | CCUGUGUCAUCAGCAGUGG | 347 |
| AD-77500 | UACCUGUACCACCUCCUGUdTdT | 348 | ACAGGAGGUGGUACAGGUAdTdT | 349 | UACCUGUACCACCUCCUGU | 350 |
| AD-77501 | GGGGAUGUCACCUCCCUUAdTdT | 351 | UAAGGGAGGUGACAUCCCCdTdT | 352 | GGGGAUGUCACCUCCCUUA | 353 |
| AD-77502 | UUGCUCACCGUGGGGAUGUdTdT | 354 | ACAUCCCCACGGUGAGCAAdTdT | 355 | UUGCUCACCGUGGGGAUGU | 356 |
| AD-77503 | AGCCGGGUCAGCCAUGUGUdTdT | 357 | ACACAUGGCUGACCCGGCUdTdT | 358 | AGCCGGGUCAGCCAUGUGU | 359 |
| AD-77504 | UCUGCCUGUGGGAUGUACUdTdT | 360 | AGUACAUCCCACAGGCAGAdTdT | 361 | UCUGCCUGUGGGAUGUACU | 362 |
| AD-77505 | AGGACAAGAUGGGGCCAUAdTdT | 363 | UAUGGCCCCAUCUUGUCCUdTdT | 364 | AGGACAAGAUGGGGCCAUC | 365 |
| AD-77506 | AUGGUGCUGGCCAGUGGAAdTdT | 366 | UUCCACUGGCCAGCACCAUdTdT | 367 | AUGGUGCUGGCCAGUGGAG | 368 |
| AD-77507 | CAUCACGACCGUGUACAUUdTdT | 369 | AAUGUACACGGUCGUGAUGdTdT | 370 | CAUCACGACCGUGUACAUU | 371 |

TABLE 5-continued

SCAP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-77508 | ACUCAGGGGCCAUCACGAAdTdT | 372 | UUCGUGAUGGCCCCUGAGUdTdT | 373 | ACUCAGGGGCCAUCACGAC | 374 |
| AD-77509 | UUCACCCUUCAGGGCCACUdTdT | 375 | AGUGGCCCUGAAGGGUGAAdTdT | 376 | UUCACCCUUCAGGGCCACU | 377 |
| AD-77510 | AGGACUCGUGCUGCCUCUUdTdT | 378 | AAGAGGCAGCACGAGUCCUdTdT | 379 | AGGACUCGUGCUGCCUCUU | 380 |
| AD-77511 | UUCCGUCUGGAGGACUCGUdTdT | 381 | ACGAGUCCUCCAGACGGAAdTdT | 382 | UUCCGUCUGGAGGACUCGU | 383 |
| AD-77512 | AGUGUUCCGUCUGGAGGAAdTdT | 384 | UUCCUCCAGACGGAACACUdTdT | 385 | AGUGUUCCGUCUGGAGGAC | 386 |
| AD-77513 | AAGACCACACACUGAGAGUdTdT | 387 | ACUCUCAGUGUGUGGUCUUdTdT | 388 | AAGACCACACACUGAGAGU | 389 |
| AD-77514 | UUGGUGACUGGGAGCCAAdTdT | 390 | UUUGGCUCCCAGUCACCAAdTdT | 391 | UUGGUGACUGGGAGCCAAG | 392 |
| AD-77515 | GGGCGCUUGGUGACUGGGAdTdT | 393 | UCCCAGUCACCAAGCGCCCdTdT | 394 | GGGCGCUUGGUGACUGGGA | 395 |
| AD-77516 | CCUGAAAGCCGCUGCUGGAdTdT | 396 | UCCAGCAGCGGCUUUCAGGdTdT | 397 | CCUGAAAGCCGCUGCUGGG | 398 |
| AD-77517 | AAAAACCCAUCACAGCCCUdTdT | 399 | AGGGCUGUGAUGGGUUUUdTdT | 400 | AAAAACCCAUCACAGCCCU | 401 |
| AD-77518 | AGUGCCCUGUGCACACCAAdTdT | 402 | UUGGUGUGCACAGGGCACUdTdT | 403 | AGUGCCCUGUGCACACCAA | 404 |
| AD-77519 | GACCCACACAGUGCCCUGUdTdT | 405 | ACAGGGCACUGUGUGGGUCdTdT | 406 | GACCCACACAGUGCCCUGU | 407 |
| AD-77520 | UACAGCAGCAGCGACACAAdTdT | 408 | UUGUGUCGCUGCUGCUGUAdTdT | 409 | UACAGCAGCAGCGACACAG | 410 |
| AD-77521 | CCCCUGCCUCUCCAGUGUAdTdT | 411 | UACACUGGAGAGGCAGGGGdTdT | 412 | CCCCUGCCUCUCCAGUGUA | 413 |
| AD-77522 | GCGGGGCAGUUCCCCUGCAdTdT | 414 | UGCAGGGGAACUGCCCCGCdTdT | 415 | GCGGGGCAGUUCCCCUGCC | 416 |
| AD-77523 | UUAGAGGGACCCCAGGGCAdTdT | 417 | UGCCCUGGGGUCCCUCUAAdTdT | 418 | UUAGAGGGACCCCAGGGCG | 419 |
| AD-77524 | CCCUCAGCCCCCUGCAGUUdTdT | 420 | AACUGCAGGGGGCUGAGGGdTdT | 421 | CCCUCAGCCCCCUGCAGUU | 422 |
| AD-77525 | UUGGAGACCCACACUGCCAdTdT | 423 | UGGCAGUGUGGGUCUCCAAdTdT | 424 | UUGGAGACCCACACUGCCC | 425 |
| AD-77526 | CCCUUGAUUUCUUCUCCUUdTdT | 426 | AAGGAGAAGAAAUCAAGGGdTdT | 427 | CCCUUGAUUUCUUCUCCUU | 428 |
| AD-77527 | UGCACGGCUCAACGGUUCAdTdT | 429 | UGAACCGUUGAGCCGUGCAdTdT | 430 | UGCACGGCUCAACGGUUCC | 431 |
| AD-77528 | UUCUUGGACAAAAGGAUUAdTdT | 432 | UAAUCCUUUUGUCCAAGAAdTdT | 433 | UUCUUGGACAAAAGGAUUG | 434 |
| AD-77529 | CGCUCUGGUGUUCUUGGAAdTdT | 435 | UUCCAAGAACACCAGAGCGdTdT | 436 | CGCUCUGGUGUUCUUGGAC | 437 |
| AD-77530 | UCUCCUCAGGCAUUACCGAdTdT | 438 | UCGGUAAUGCCUGAGGAGAdTdT | 439 | UCUCCUCAGGCAUUACCGC | 440 |
| AD-77531 | UGCAGCAGCGAGGAGGUCUdTdT | 441 | AGACCUCCUCGCUGCUGCAdTdT | 442 | UGCAGCAGCGAGGAGGUCU | 443 |
| AD-77532 | ACGCCAUUGAAGGGGUGCUdTdT | 444 | AGCACCCCUUCAAUGGCGUdTdT | 445 | ACGCCAUUGAAGGGGUGCU | 446 |
| AD-77533 | GCGGAGCAGCGGCCGGCUAdTdT | 447 | UAGCCGGCCGCUGCUCCGCdTdT | 448 | GCGGAGCAGCGGCCGGCUG | 449 |
| AD-77534 | ACCUCAUCGUGGUGGGGCAdTdT | 450 | UGCCCCACCACGAUGAGGUdTdT | 451 | ACCUCAUCGUGGUGGGGCG | 452 |
| AD-77535 | UUGGAGCUGCAGGGCAACAdTdT | 453 | UGUUGCCCUGCAGCUCCAAdTdT | 454 | UUGGAGCUGCAGGGCAACC | 455 |
| AD-77536 | AGGGUUCCAUCUGGAGCUUdTdT | 456 | AAGCUCCAGAUGGAACCCUdTdT | 457 | AGGGUUCCAUCUGGAGCUU | 458 |
| AD-77537 | CCCAGUGCCGAGGGUUCCAdTdT | 459 | UGGAACCCUCGGCACUGGGdTdT | 460 | CCCAGUGCCGAGGGUUCCA | 461 |
| AD-77538 | UUCCCUCGCCUGGGCCCCAdTdT | 462 | UGGGGCCCAGGCGAGGGAAdTdT | 463 | UUCCCUCGCCUGGGCCCCC | 464 |
| AD-77539 | CCCGAGAAAGGCUCCCCUUdTdT | 465 | AAGGGGAGCCUUUCUCGGGdTdT | 466 | CCCGAGAAAGGCUCCCCUU | 467 |
| AD-77540 | GCUCCCCGAGAAAGGCUAdTdT | 468 | UAGCCUUUCUCGGGGAGCdTdT | 469 | GCUCCCCGAGAAAGGCUC | 470 |
| AD-77541 | CCUGAGGACGAGGGUGGCUdTdT | 471 | AGCACCCUCGUCCUCAGGdTdT | 472 | CCUGAGGACGAGGGUGGCU | 473 |
| AD-77542 | CGGUGCUGUCCCAGGCCCdTdT | 474 | UGGGCCUGGGACAGCACCGdTdT | 475 | CGGUGCUGUCCCAGGCCCC | 476 |
| AD-77543 | CCUCGCCUGGGCCGGUGCUdTdT | 477 | AGCACCGGCCCAGGCGAGGdTdT | 478 | CCUCGCCUGGGCCGGUGCU | 479 |
| AD-77544 | CCAGCCCUGCGCCCACCCUdTdT | 480 | AGGGUGGGCGCAGGGCUGGdTdT | 481 | CCAGCCCUGCGCCCACCCU | 482 |

TABLE 5-continued

SCAP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-77545 | GCUGGCGGCCGUCUGCACAdTdT | 483 | UGUGCAGACGGCCGCCAGCdTdT | 484 | GCUGGCGGCCGUCUGCACA | 485 |
| AD-77546 | UGUACCAGGAGGAGGGGCUdTdT | 486 | AGCCCCUCCUCCUGGUACAdTdT | 487 | UGUACCAGGAGGAGGGGCU | 488 |
| AD-77547 | CUGCCUGGUGCAGCGGGUAdTdT | 489 | UACCCGCUGCACCAGGCAGdTdT | 490 | CUGCCUGGUGCAGCGGGUG | 491 |
| AD-77548 | UCUCGGGACUCCCCAGGCUdTdT | 492 | AGCCUGGGGAGUCCCGAGAdTdT | 493 | UCUCGGGACUCCCCAGGCU | 494 |
| AD-77549 | UGUGGCCGCUCUCGGGACUdTdT | 495 | AGUCCCGAGAGCGGCCACAdTdT | 496 | UGUGGCCGCUCUCGGGACU | 497 |
| AD-77550 | CCGGCACCGGGCGGUCUGUdTdT | 498 | ACAGACCGCCCGGUGCCGGdTdT | 499 | CCGGCACCGGGCGGUCUGU | 500 |
| AD-77551 | CAGCCCGAGCCCCGGCACAdTdT | 501 | UGUGCCGGGGCUCGGGCUGdTdT | 502 | CAGCCCGAGCCCCGGCACC | 503 |
| AD-77552 | GUCCUCACAGCCCACUCAAdTdT | 504 | UUGAGUGGGCUGUGAGGACdTdT | 505 | GUCCUCACAGCCCACUCAG | 506 |
| AD-77553 | UUUCAGCGCAGCCUCGGUAdTdT | 507 | UACCGAGGCUGCGCUGAAAdTdT | 508 | UUUCAGCGCAGCCUCGGUC | 509 |
| AD-77554 | UUAAUUGACACCAACUUUUdTdT | 510 | AAAAGUUGGUGUCAAUUAAdTdT | 511 | UUAAUUGACACCAACUUUU | 512 |
| AD-77555 | ACCUCACCUGCUUAAUUGAdTdT | 513 | UCAAUUAAGCAGGUGAGGUdTdT | 514 | ACCUCACCUGCUUAAUUGA | 515 |
| AD-77556 | UUCGGGGACCAGCCUGACAdTdT | 516 | UGUCAGGCUGGUCCCCGAAdTdT | 517 | UUCGGGGACCAGCCUGACC | 518 |
| AD-77557 | CUCCGCCGCCUUCCCUCUUdTdT | 519 | AAGAGGGAAGGCGGCGGAGdTdT | 520 | CUCCGCCGCCUUCCCUCUU | 521 |
| AD-77558 | CCUCCCCUGAGACACCGCAdTdT | 522 | UGCGGUGUCUCAGGGGAGGdTdT | 523 | CCUCCCCUGAGACACCGCC | 524 |
| AD-77561 | CCUAAGCAGCGAGAGCUGAdTdT | 525 | UCAGCUCUCGCUGCUUAGGdTdT | 526 | CCUAAGCAGCGAGAGCUGG | 527 |
| AD-77562 | CUGCGGAUCGCCCAAGGCAdTdT | 528 | UGCCUUGGGCGAUCCGCAGdTdT | 529 | CUGCGGAUCGCCCAAGGCC | 530 |
| AD-77563 | CCUGGAGGUGAAGCUGCGAdTdT | 531 | UCGCAGCUUCACCUCCAGGdTdT | 532 | CCUGGAGGUGAAGCUGCGG | 533 |
| AD-77564 | UCUCAACCCCGGUAGACCUdTdT | 534 | AGGUCUACCGGGGUUGAGAdTdT | 535 | UCUCAACCCCGGUAGACCU | 536 |
| AD-77565 | AAGUCUGUGGUCUCAACCAdTdT | 537 | UGGUUGAGACCACAGACUUdTdT | 538 | AAGUCUGUGGUCUCAACCC | 539 |
| AD-77566 | UUAUUGGGUUAGAGAAUGUdTdT | 540 | ACAUUCUCUAACCCAAUAAdTdT | 541 | UUAUUGGGUUAGAGAAUGU | 542 |
| AD-77567 | GGUGGUUAUUGGGUUAGAAdTdT | 543 | UUCUAACCCAAUAACCACCdTdT | 544 | GGUGGUUAUUGGGUUAGAG | 545 |
| AD-77568 | UUUUCCCCUACCUUGUGGUdTdT | 546 | ACCACAAGGUAGGGGAAAAdTdT | 547 | UUUUCCCCUACCUUGUGGU | 548 |
| AD-77569 | CCUCAAUGGCGGCGAGAUUdTdT | 549 | AAUCUCGCCGCCAUUGAGGdTdT | 550 | CCUCAAUGGCGGCGAGAUU | 551 |
| AD-77570 | UUCGGCCUGACGCCCACCAdTdT | 552 | UGGUGGGCGUCAGGCCGAAdTdT | 553 | UUCGGCCUGACGCCCACCC | 554 |
| AD-77571 | UGCACACUCUUCGGCCUGAdTdT | 555 | UCAGGCCGAAGAGUGUGCAdTdT | 556 | UGCACACUCUUCGGCCUGA | 557 |
| AD-77572 | CAUGUCUGUGGGACUCUGAdTdT | 558 | UCAGAGUCCCACAGACAUGdTdT | 559 | CAUGUCUGUGGGACUCUGC | 560 |
| AD-77573 | GCUGCUCAUGUCUGUGGGAdTdT | 561 | UCCCACAGACAUGAGCAGCdTdT | 562 | GCUGCUCAUGUCUGUGGGA | 563 |
| AD-77574 | UCACAGUGCUCAGCUCGCUdTdT | 564 | AGCGAGCUGAGCACUGUGAdTdT | 565 | UCACAGUGCUCAGCUCGCU | 566 |
| AD-77575 | GGCCUGGCUGCCGUGGUAdTdT | 567 | UACCACGGCAGCCAGGGCCdTdT | 568 | GGCCCUGGCUGCCGUGGUC | 569 |
| AD-77576 | CAAGUGGGGCUGGCCCUAdTdT | 570 | UAGGGCCAGCCCCACUUGdTdT | 571 | CAAGUGGGGCUGGCCCUG | 572 |
| AD-77577 | UCGACAUGGUCAAGUCCAAdTdT | 573 | UUGGACUUGACCAUGUCGAdTdT | 574 | UCGACAUGGUCAAGUCCAA | 575 |
| AD-77578 | UUCUCCACGCGGAAGAUCAdTdT | 576 | UGAUCUUCCGCGUGGAGAAdTdT | 577 | UUCUCCACGCGGAAGAUCG | 578 |
| AD-77579 | UGUUUGCCUACAUCUACUUdTdT | 579 | AAGUAGAUGUAGGCAAACAdTdT | 580 | UGUUUGCCUACAUCUACUU | 581 |
| AD-77580 | GACCACCUACAUCAUCUUAdTdT | 582 | UAAGAUGAUGUAGGUGGUCdTdT | 583 | GACCACCUACAUCAUCUUG | 584 |
| AD-77581 | CAUCCCCCUUGUGACCACAdTdT | 585 | UGUGGUCACAAGGGGGAUGdTdT | 586 | CAUCCCCCUUGUGACCACC | 587 |
| AD-77582 | UUGGUGUCGCUGAGCUCAUdTdT | 588 | AUGAGCUCAGCGACACCAAdTdT | 589 | UUGGUGUCGCUGAGCUCAU | 590 |
| AD-77583 | GCACUUCAAGGAGGAGAUUdTdT | 591 | AAUCUCCUCCUUGAAGUGCdTdT | 592 | GCACUUCAAGGAGGAGAUU | 593 |

TABLE 5-continued

SCAP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-77584 | GAGAGCCUGGUCCACGUGAdTdT | 594 | UCACGUGGACCAGGCUCUCdTdT | 595 | GAGAGCCUGGUCCACGUGC | 596 |
| AD-77585 | ACUGCAGCCUUCGGGCGGAdTdT | 597 | UCCGCCCGAAGGCUGCAGUdTdT | 598 | ACUGCAGCCUUCGGGCGGA | 599 |
| AD-77586 | UUCUGCACCCCAGCCCCAAdTdT | 600 | UUGGGGCUGGGGUGCAGAAdTdT | 601 | UUCUGCACCCCAGCCCCAA | 602 |
| AD-77587 | GUGCCCGCCUGAUGCUUCUdTdT | 603 | AGAAGCAUCAGGCGGGCACdTdT | 604 | GUGCCCGCCUGAUGCUUCU | 605 |
| AD-77588 | UUCCUGGGCAGCCUGCGUAdTdT | 606 | UACGCAGGCUGCCCAGGAAdTdT | 607 | UUCCUGGGCAGCCUGCGUG | 608 |
| AD-77589 | UGCCAAGUUCCUGGGCAGAdTdT | 609 | UCUGCCCAGGAACUUGGCAdTdT | 610 | UGCCAAGUUCCUGGGCAGC | 611 |
| AD-77590 | UCUUCCAGCACUACCAUGAdTdT | 612 | UCAUGGUAGUGCUGGAAGAdTdT | 613 | UCUUCCAGCACUACCAUGC | 614 |
| AD-77591 | UACACCAUCACCCUGGUCUdTdT | 615 | AGACCAGGGUGAUGGUGUAdTdT | 616 | UACACCAUCACCCUGGUCU | 617 |
| AD-77592 | GGAAGAGGAUGGUCUCCUAdTdT | 618 | UAGGAGACCAUCCUCUUCCdTdT | 619 | GGAAGAGGAUGGUCUCCUA | 620 |
| AD-77593 | UCUACACCAGGAAGAGGAUdTdT | 621 | AUCCUCUUCCUGGUGUAGAdTdT | 622 | UCUACACCAGGAAGAGGAU | 623 |
| AD-77594 | UACAGCGGGGUGAGCCUCUdTdT | 624 | AGAGGCUCACCCCGCUGUAdTdT | 625 | UACAGCGGGGUGAGCCUCU | 626 |
| AD-77595 | ACUUGUUAUUGGUGUUCAdTdT | 627 | UGAACACCAAAUAACAAGUdTdT | 628 | ACUUGUUAUUGGUGUUCC | 629 |
| AD-77596 | UCAGCCACACUCAAAGACUdTdT | 630 | AGUCUUUGAGUGUGGCUGAdTdT | 631 | UCAGCCACACUCAAAGACU | 632 |
| AD-77597 | UGCAGACUUCAGCCACACUdTdT | 633 | AGUGUGGCUGAAGUCUGCAdTdT | 634 | UGCAGACUUCAGCCACACU | 635 |
| AD-77598 | CACGAGCCUAAAACCCUGAdTdT | 636 | UCAGGGUUUUAGGCUCGUGdTdT | 637 | CACGAGCCUAAAACCCUGC | 638 |
| AD-77599 | UCCACCAGCACGAGCCUAAdTdT | 639 | UUAGGCUCGUGCUGGUGGAdTdT | 640 | UCCACCAGCACGAGCCUAA | 641 |
| AD-77600 | GACAUCAUUGGGACCAUCAdTdT | 642 | UGAUGGUCCCAAUGAUGUCdTdT | 643 | GACAUCAUUGGGACCAUCC | 644 |
| AD-77601 | CUUCCAUGCUGAUCCUGAAdTdT | 645 | UUCAGGAUCAGCAUGGAAGdTdT | 646 | CUUCCAUGCUGAUCCUGAC | 647 |
| AD-77602 | AGAAUGACUGGGAACGCUUdTdT | 648 | AAGCGUUCCCAGUCAUUCUdTdT | 649 | AGAAUGACUGGGAACGCUU | 650 |
| AD-77603 | UCUGGCAGAAUGACUGGGAdTdT | 651 | UCCCAGUCAUUCUGCCAGAdTdT | 652 | UCUGGCAGAAUGACUGGGA | 653 |
| AD-77604 | CUGUCCCCUGGGAACUUCUdTdT | 654 | AGAAGUUCCCAGGGGACAGdTdT | 655 | CUGUCCCCUGGGAACUUCU | 656 |
| AD-77605 | CCUGCUGCUGUCCCCUGGAdTdT | 657 | UCCAGGGGACAGCAGCAGGdTdT | 658 | CCUGCUGCUGUCCCCUGGG | 659 |
| AD-77606 | UCCCUGAGCAUGGAUGCCUdTdT | 660 | AGGCAUCCAUGCUCAGGGAdTdT | 661 | UCCCUGAGCAUGGAUGCCU | 662 |
| AD-77607 | CCUACUCCCUGAGCAUGGAdTdT | 663 | UCCAUGCUCAGGGAGUAGGdTdT | 664 | CCUACUCCCUGAGCAUGGA | 665 |
| AD-77608 | UUAGGAAGCUCAGGAACCUdTdT | 666 | AGGUUCCUGAGCUUCCUAAdTdT | 667 | UUAGGAAGCUCAGGAACCU | 668 |
| AD-77609 | CGACCUGCUGCCAGGCCUUdTdT | 669 | AAGGCCUGGCAGCAGGUCGdTdT | 670 | CGACCUGCUGCCAGGCCUU | 671 |
| AD-77610 | UGUGUCUGCAAGUGACCGAdTdT | 672 | UCGGUCACUUGCAGACACAdTdT | 673 | UGUGUCUGCAAGUGACCGA | 674 |
| AD-77611 | AGGAGCUUGGAGGAGUUGUdTdT | 675 | ACAACUCCUCCAAGCUCCUdTdT | 676 | AGGAGCUUGGAGGAGUUGU | 677 |
| AD-77612 | GAGACAGCUCUGGGAUCAAdTdT | 678 | UUGAUCCCAGAGCUGUCUCdTdT | 679 | GAGACAGCUCUGGGAUCAG | 680 |
| AD-77613 | CGUGCUGAGAGACAGCUCUdTdT | 681 | AGAGCUGUCUCUCAGCACGdTdT | 682 | CGUGCUGAGAGACAGCUCU | 683 |
| AD-77614 | GAGGAGAUCCGGAACCACAdTdT | 684 | UGUGGUUCCGGAUCUCCUCdTdT | 685 | GAGGAGAUCCGGAACCACG | 686 |
| AD-77615 | GGGCAUUCCAACUGGUGGAdTdT | 687 | UCCACCAGUUGGAAUGCCCdTdT | 688 | GGGCAUUCCAACUGGUGGA | 689 |
| AD-77616 | UCGUUCACCUUUGUCCCGAdTdT | 690 | UCGGGACAAAGGUGAACGAdTdT | 691 | UCGUUCACCUUUGUCCCGG | 692 |
| AD-77617 | GUAUUUCGUUCACCUUUGUdTdT | 693 | ACAAAGGUGAACGAAAUACdTdT | 694 | GUAUUUCGUUCACCUUUGU | 695 |
| AD-77618 | CCUCCUGGCAGUAGAUGUAdTdT | 696 | UACAUCUACUGCCAGGAGGdTdT | 697 | CCUCCUGGCAGUAGAUGUA | 698 |
| AD-77619 | UUCCCUGGCACAAGAACCUdTdT | 699 | AGGUUCUUGUGCCAGGGAAdTdT | 700 | UUCCCUGGCACAAGAACCU | 701 |
| AD-77620 | UGUGAAGUCCUCAGUGUUUdTdT | 702 | AAACACUGAGGACUUCACAdTdT | 703 | UGUGAAGUCCUCAGUGUUU | 704 |

TABLE 5-continued

SCAP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-77621 | UUAUGUCCAGCAGAUAUUUdTdT | 705 | AAAUAUCUGCUGGACAUAAdTdT | 706 | UUAUGUCCAGCAGAUAUUU | 707 |
| AD-77622 | CCCGGUGGCUUAUGUCCAAdTdT | 708 | UUGGACAUAAGCCACCGGGdTdT | 709 | CCCGGUGGCUUAUGUCCAG | 710 |
| AD-77623 | AGUGGUAUGUGGGUGCCCAdTdT | 711 | UGGGCACCCACAUACCACUdTdT | 712 | AGUGGUAUGUGGGUGCCCC | 713 |
| AD-77624 | CCUACUGAGCAGCCUGAGUdTdT | 714 | ACUCAGGCUGCUCAGUAGGdTdT | 715 | CCUACUGAGCAGCCUGAGU | 716 |
| AD-77625 | CCACCUGUGGACUCUGACAdTdT | 717 | UGUCAGAGUCCACAGGUGGdTdT | 718 | CCACCUGUGGACUCUGACC | 719 |
| AD-77626 | UUACUCGCCCCCACCUGUAdTdT | 720 | UACAGGUGGGGGCGAGUAAdTdT | 721 | UUACUCGCCCCCACCUGUG | 722 |
| AD-77627 | CCUGUGAAGGAUUACUCGAdTdT | 723 | UCGAGUAAUCCUUCACAGGdTdT | 724 | CCUGUGAAGGAUUACUCGC | 725 |
| AD-77628 | UGUGGAAUUCACCACCCCUdTdT | 726 | AGGGGUGGUGAAUUCCACAdTdT | 727 | UGUGGAAUUCACCACCCCU | 728 |
| AD-77629 | CCUUGCCAGGAACAGGACAdTdT | 729 | UGUCCUGUUCCUGGCAAGGdTdT | 730 | CCUUGCCAGGAACAGGACC | 731 |
| AD-77630 | UACCCACUGCUGAAACUCAdTdT | 732 | UGAGUUUCAGCAGUGGGUAdTdT | 733 | UACCCACUGCUGAAACUCC | 734 |
| AD-77631 | GCUGCUACCCACUGCUGAAdTdT | 735 | UUCAGCAGUGGGUAGCAGCdTdT | 736 | GCUGCUACCCACUGCUGAA | 737 |
| AD-77632 | UUCUGCAUCUUAGCCUGCUdTdT | 738 | AGCAGGCUAAGAUGCAGAAdTdT | 739 | UUCUGCAUCUUAGCCUGCU | 740 |
| AD-77633 | UCAUCCUCUUCACAGGGUUdTdT | 741 | AACCCUGUGAAGAGGAUGAdTdT | 742 | UCAUCCUCUUCACAGGGUU | 743 |
| AD-77634 | AUCCUAUCCCAUCCCCAUAdTdT | 744 | UAUGGGGAUGGGAUAGGAUdTdT | 745 | AUCCUAUCCCAUCCCCAUC | 746 |
| AD-77635 | UCUGUGCAUCCUAUCCCAUdTdT | 747 | AUGGGAUAGGAUGCACAGAdTdT | 748 | UCUGUGCAUCCUAUCCCAU | 749 |
| AD-77636 | UACAACCAUGGGCUCCUCUdTdT | 750 | AGAGGAGCCCAUGGUUGUAdTdT | 751 | UACAACCAUGGGCUCCUCU | 752 |
| AD-77637 | CCUGACUGAAAGGCUGCGUdTdT | 753 | ACGCAGCCUUUCAGUCAGGdTdT | 754 | CCUGACUGAAAGGCUGCGU | 755 |
| AD-77638 | UUCGGCUGAGGAUGACCCUdTdT | 756 | AGGGUCAUCCUCAGCCGAAdTdT | 757 | UUCGGCUGAGGAUGACCCU | 758 |
| AD-77639 | UUCCGGGAUGGCAGCAAGAdTdT | 759 | UCUUGCUGCCAUCCCGGAAdTdT | 760 | UUCCGGGAUGGCAGCAAGG | 761 |
| AD-77640 | GGUGAUCCAUGGUCACUUUdTdT | 762 | AAAGUGACCAUGGAUCACCdTdT | 763 | GGUGAUCCAUGGUCACUUU | 764 |
| AD-77641 | UGUCAAGUGUGUGCCAGGAdTdT | 765 | UCCUGGCACACACUUGACAdTdT | 766 | UGUCAAGUGUGUGCCAGGG | 767 |
| AD-77642 | UUGUUCUUUGUCAGUGCUAdTdT | 768 | UAGCACUGACAAAGAACAAdTdT | 769 | UUGUUCUUUGUCAGUGCUG | 770 |
| AD-77643 | UACCUGCACAUGUUGUUCUdTdT | 771 | AGAACAACAUGUGCAGGUAdTdT | 772 | UACCUGCACAUGUUGUUCU | 773 |
| AD-77644 | GCUGCCACCACAGGUACCUdTdT | 774 | AGGUACCUGUGGUGGCAGCdTdT | 775 | GCUGCCACCACAGGUACCU | 776 |
| AD-77645 | CCGCAGCUUGGGAGGUGCUdTdT | 777 | AGCACCUCCCAAGCUGCGGdTdT | 778 | CCGCAGCUUGGGAGGUGCU | 779 |
| AD-77646 | GCCGCCGCCGCCGCCGCAAdTdT | 780 | UUGCGGCGGCGGCGGCGGCdTdT | 781 | GCCGCCGCCGCCGCCGCAG | 782 |
| AD-77647 | UGCCGCCCCGUCGCCGCAdTdT | 783 | UGCGGCGACGGGGGCGGCAdTdT | 784 | UGCCGCCCCGUCGCCGCC | 785 |
| AD-77648 | CCGCGCUCCGCCCCUGCUAdTdT | 786 | UAGCAGGGGCGGAGCGCGGdTdT | 787 | CCGCGCUCCGCCCCUGCUG | 788 |
| AD-77649 | GCACGCCGCGCUCCGCCCAdTdT | 789 | UGGGCGGAGCGCGGCGUGCdTdT | 790 | GCACGCCGCGCUCCGCCCC | 791 |
| AD-77650 | GCGCCACGCACCGGACUGAdTdT | 792 | UCAGUCCGGUGCGUGGCGCdTdT | 793 | GCGCCACGCACCGGACUGC | 794 |
| AD-77651 | AGGAGAGAGGGAGGGCAdTdT | 795 | UGCCCUCCCUCUCUCCUdTdT | 796 | AGGAGAGAGGGAGGGCG | 797 |
| AD-77652 | GCGGGCACCCGGCGGCCAAdTdT | 798 | UUGGCCGCCGGGUGCCCGCdTdT | 799 | GCGGGCACCCGGCGGCCAG | 800 |
| AD-77653 | UUCAGAUGGUGGGAAGGCUdTdT | 801 | AGCCUUCCCACCAUCUGAAdTdT | 802 | UUCAGAUGGUGGGAAGGCU | 803 |
| AD-77654 | AGGAGAGCUGGGAACGACUdTdT | 804 | AGUCGUUCCCAGCUCUCCUdTdT | 805 | AGGAGAGCUGGGAACGACU | 806 |
| AD-77655 | CAGCGGGCUUGAGGCUCAAdTdT | 807 | UUGAGCCUCAAGCCCGCUGdTdT | 808 | CAGCGGGCUUGAGGCUCAG | 809 |
| AD-77656 | CGGGACAGUGGCGUGGGCAdTdT | 810 | UGCCCACGCCACUGUCCCGdTdT | 811 | CGGGACAGUGGCGUGGGCA | 812 |
| AD-77657 | AGCGCCGGGACAGUGGCGUdTdT | 813 | ACGCCACUGUCCCGGCGCUdTdT | 814 | AGCGCCGGGACAGUGGCGU | 815 |

TABLE 5-continued

SCAP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-77658 | CCGCGCCCAGGCAGGCAGAdTdT | 816 | UCUGCCUGCCUGGGCGCGGdTdT | 817 | CCGCGCCCAGGCAGGCAGC | 818 |
| AD-77659 | UUGCCUAACGCGCAUUCCAdTdT | 819 | UGGAAUGCGCGUUAGGCAAdTdT | 820 | UUGCCUAACGCGCAUUCCG | 821 |
| AD-77660 | GACGCGCAGACCGGGGAUUdTdT | 822 | AAUCCCCGGUCUGCGCGUCdTdT | 823 | GACGCGCAGACCGGGGAUU | 824 |
| AD-77661 | UCUGCGUGUGGGACGCGCAdTdT | 825 | UGCGCGUCCCACACGCAGAdTdT | 826 | UCUGCGUGUGGGACGCGCA | 827 |
| AD-77662 | GCAUGCUGCUGGUGAGCUAdTdT | 828 | UAGCUCACCAGCAGCAUGCdTdT | 829 | GCAUGCUGCUGGUGAGCUG | 830 |
| AD-77663 | UGCCUGGCCAGCGACGGCAdTdT | 831 | UGCCGUCGCUGGCCAGGCAdTdT | 832 | UGCCUGGCCAGCGACGGCA | 833 |
| AD-77664 | CCUCAUGGACAUCGAGUGAdTdT | 834 | UCACUCGAUGUCCAUGAGGdTdT | 835 | CCUCAUGGACAUCGAGUGC | 836 |
| AD-77665 | UUGUGCUGCGCGGCCACCUdTdT | 837 | AGGUGGCCGCGCAGCACAAdTdT | 838 | UUGUGCUGCGCGGCCACCU | 839 |
| AD-77666 | GACGGAGAUCGUGCCGCUUdTdT | 840 | AAGCGGCACGAUCUCCGUCdTdT | 841 | GACGGAGAUCGUGCCGCUU | 842 |
| AD-77667 | CCGAGACGGAGAUCGUGCAdTdT | 843 | UGCACGAUCUCCGUCUCGGdTdT | 844 | CCGAGACGGAGAUCGUGCC | 845 |
| AD-77668 | UACGGCUAUGCGCCACCCAdTdT | 846 | UGGGUGGCGCAUAGCCGUAdTdT | 847 | UACGGCUAUGCGCCACCCG | 848 |
| AD-77669 | UGCCCUGCGACGACUACGAdTdT | 849 | UCGUAGUCGUCGCAGGGCAdTdT | 850 | UGCCCUGCGACGACUACGG | 851 |
| AD-77670 | CGGAGGCGCGGGGAGCUGAdTdT | 852 | UCAGCUCCCCGCGCCUCCGdTdT | 853 | CGGAGGCGCGGGGAGCUGC | 854 |
| AD-77671 | CGCAACUACGGGCAGCUGAdTdT | 855 | UCAGCUGCCCGUAGUUGCGdTdT | 856 | CGCAACUACGGGCAGCUGG | 857 |
| AD-77672 | GCUAUGCCCGCGCAACUAAdTdT | 858 | UUAGUUGCGCGGGCAUAGCdTdT | 859 | GCUAUGCCCGCGCAACUAC | 860 |
| AD-77673 | UCUGCCUCUACCGCGUGCUdTdT | 861 | AGCACGCGGUAGAGGCAGAdTdT | 862 | UCUGCCUCUACCGCGUGCU | 863 |
| AD-77674 | UGGCCACCGGCAUCGUCUUdTdT | 864 | AAGACGAUGCCGGUGGCCAdTdT | 865 | UGGCCACCGGCAUCGUCUU | 866 |
| AD-77675 | GCUGGGCCUGGCCACCGGAdTdT | 867 | UCCGGUGGCCAGGCCCAGCdTdT | 868 | GCUGGGCCUGGCCACCGGC | 869 |
| AD-77676 | UGUACAAGGUGGCGGCGCUdTdT | 870 | AGCGCCGCCACCUUGUACAdTdT | 871 | UGUACAAGGUGGCGGCGCU | 872 |
| AD-77677 | UCACGCUGUACAAGGUGGAdTdT | 873 | UCCACCUUGUACAGCGUGAdTdT | 874 | UCACGCUGUACAAGGUGGC | 875 |
| AD-77678 | CAGGCCCAUGGAGACGUCAdTdT | 876 | UGACGUCUCCAUGGGCCUGdTdT | 877 | CAGGCCCAUGGAGACGUCA | 878 |
| AD-77679 | AGGUGGGGUGCAGGCCCAUdTdT | 879 | AUGGGCCUGCACCCCACCUdTdT | 880 | AGGUGGGGUGCAGGCCCAU | 881 |
| AD-77680 | CAGGACCCAAGGGCCCAGAdTdT | 882 | UCUGGGCCCUUGGGUCCUGdTdT | 883 | CAGGACCCAAGGGCCCAGG | 884 |
| AD-77681 | UGCUGGGCACUGGGAAGCAdTdT | 885 | UGCUUCCCAGUGCCCAGCAdTdT | 886 | UGCUGGGCACUGGGAAGCA | 887 |
| AD-77682 | CCACCGGGGCCCAUACCUAdTdT | 888 | UAGGUAUGGGCCCCGGUGGdTdT | 889 | CCACCGGGGCCCAUACCUG | 890 |
| AD-77683 | ACCCUCAGGACGCCGCAAdTdT | 891 | UUGCGGCCGUCCUGAGGGUdTdT | 892 | ACCCUCAGGACGGCCGCAG | 893 |
| AD-77684 | GCUCUGGAGGGCCGGCACAdTdT | 894 | UGUGCCGGCCCUCCAGAGCdTdT | 895 | GCUCUGGAGGGCCGGCACC | 896 |
| AD-77685 | GCUCCGCCUGAACCCGAGAdTdT | 897 | UCUCGGGUUCAGGCGGAGCdTdT | 898 | GCUCCGCCUGAACCCGAGG | 899 |
| AD-77686 | CCGUCAUCCCAGUCACGCUdTdT | 900 | AGCGUGACUGGGAUGACGGdTdT | 901 | CCGUCAUCCCAGUCACGCU | 902 |
| AD-77687 | UACAUCAGCCUGCUGCCCAdTdT | 903 | UGGGCAGCAGGCUGAUGUAdTdT | 904 | UACAUCAGCCUGCUGCCCG | 905 |
| AD-77688 | CCAAGAGGUACAUCAGCCUdTdT | 906 | AGGCUGAUGUACCUCUUGGdTdT | 907 | CCAAGAGGUACAUCAGCCU | 908 |
| AD-77689 | UACAACAUCACACUGGCCAdTdT | 909 | UGGCCAGUGUGAUGUUGUAdTdT | 910 | UACAACAUCACACUGGCCA | 911 |
| AD-77690 | CGACGCUCUUCAGCUAUUAdTdT | 912 | UAAUAGCUGAAGAGCGUCGdTdT | 913 | CGACGCUCUUCAGCUAUUA | 914 |
| AD-77691 | UCCGCCACUGGCCGACGCUdTdT | 915 | AGCGUCGGCCAGUGGCGGAdTdT | 916 | UCCGCCACUGGCCGACGCU | 917 |
| AD-77692 | AUUGUCCUUCCGCCACUGAdTdT | 918 | UCAGUGGCGGAAGGACAAUdTdT | 919 | AUUGUCCUUCCGCCACUGG | 920 |
| AD-77693 | AGGAACUUUGGAGGAAAUUdTdT | 921 | AAUUUCCUCCAAAGUUCCUdTdT | 922 | AGGAACUUUGGAGGAAAUU | 923 |
| AD-77694 | CUGGGGGCCUGAGGAUGAAdTdT | 924 | UUCAUCCUCAGGCCCCCAGdTdT | 925 | CUGGGGGCCUGAGGAUGAG | 926 |

TABLE 5-continued

SCAP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-77695 | AGUCCCAGAGGUUAACCUGAdTdT | 927 | UCAGGUUACCUCUGGGACUdTdT | 928 | AGUCCCAGAGGUUAACCUGG | 929 |
| AD-77696 | UUGUCCAUGACAGCCCAGUdTdT | 930 | ACUGGGCUGUCAUGGACAAdTdT | 931 | UUGUCCAUGACAGCCCAGU | 932 |
| AD-77697 | AGGUCCAGCAGAGGUUGUAdTdT | 933 | UACAACCUCUGCUGGACCUdTdT | 934 | AGGUCCAGCAGAGGUUGUC | 935 |
| AD-77698 | AGUCACCUGAGCGUGGAGAdTdT | 936 | UCUCCACGCUCAGGUGACUdTdT | 937 | AGUCACCUGAGCGUGGAGG | 938 |
| AD-77699 | CAGACGUCGCCAGGCGAGUdTdT | 939 | ACUCGCCUGGCGACGUCUGdTdT | 940 | CAGACGUCGCCAGGCGAGU | 941 |
| AD-77700 | UAAGCUACCUGAGAACCAAdTdT | 942 | UUGGUUCUCAGGUAGCUUAdTdT | 943 | UAAGCUACCUGAGAACCAG | 944 |
| AD-77701 | CUGAUGCCCCUAAGCUACAdTdT | 945 | UGUAGCUUAGGGGCAUCAGdTdT | 946 | CUGAUGCCCCUAAGCUACC | 947 |
| AD-77702 | UUCUCCAUCUUCCCACCUAdTdT | 948 | UAGGUGGGAAGAUGGAGAAdTdT | 949 | UUCUCCAUCUUCCCACCUG | 950 |
| AD-77703 | UGCCUUCUCCAUCUUCCCAdTdT | 951 | UGGGAAGAUGGAGAAGGCAdTdT | 952 | UGCCUUCUCCAUCUUCCCA | 953 |
| AD-77704 | CCAGCCACCCGGACCCUGAdTdT | 954 | UCAGGGUCCGGGUGGCUGGdTdT | 955 | CCAGCCACCCGGACCCUGC | 956 |
| AD-77705 | UGCCCCCAGCCACCCGGAdTdT | 957 | UCCGGGUGGCUGGGGGCAdTdT | 958 | UGCCCCCAGCCACCCGGA | 959 |
| AD-77706 | GUGCCUAGUGGCAUGCUGAdTdT | 960 | UCAGCAUGCCACUAGGCACdTdT | 961 | GUGCCUAGUGGCAUGCUGC | 962 |
| AD-77707 | CCUGGCUCCCAUGCCCGUAdTdT | 963 | UACGGGCAUGGGAGCCAGGdTdT | 964 | CCUGGCUCCCAUGCCCGUG | 965 |
| AD-77708 | CAUUGGGUGAGGGAGCCCUdTdT | 966 | AGGGCUCCCUCACCCAAUGdTdT | 967 | CAUUGGGUGAGGGAGCCCU | 968 |
| AD-77709 | CAGGUGACGGAACAGAGCAdTdT | 969 | UGCUCUGUUCCGUCACCUGdTdT | 970 | CAGGUGACGGAACAGAGCC | 971 |
| AD-77710 | GCUGCCCAGGUGACGGAAAdTdT | 972 | UUUCCGUCACCUGGGCAGCdTdT | 973 | GCUGCCCAGGUGACGGAAC | 974 |
| AD-77711 | GCUGCGCAACUACCUCGCUdTdT | 975 | AGCGAGGUAGUUGCGCAGCdTdT | 976 | GCUGCGCAACUACCUCGCU | 977 |
| AD-77712 | ACACAGACCCAGCAGGGCUdTdT | 978 | AGCCCUGCUGGGUCUGUGUdTdT | 979 | ACACAGACCCAGCAGGGCU | 980 |
| AD-77713 | CCUGGUAUACACAGACCCAdTdT | 981 | UGGGUCUGUGUAUACCAGGdTdT | 982 | CCUGGUAUACACAGACCCA | 983 |
| AD-77714 | UUGUCUGGAUUGGCAUCCUdTdT | 984 | AGGAUGCCAAUCCAGACAAdTdT | 985 | UUGUCUGGAUUGGCAUCCU | 986 |
| AD-77715 | CAUCAUGGCUGGCACCGUUdTdT | 987 | AACGGUGCCAGCCAUGAUGdTdT | 988 | CAUCAUGGCUGGCACCGUU | 989 |
| AD-77716 | GCCUGGCACAGCGCCUCAUdTdT | 990 | AUGAGGCGCUGUGCCAGGCdTdT | 991 | GCCUGGCACAGCGCCUCAU | 992 |
| AD-77717 | UUCCUGGCCCGCACCCGCAdTdT | 993 | UGCGGGUGCGGGCCAGGAAdTdT | 994 | UUCCUGGCCCGCACCCGCC | 995 |
| AD-77718 | GGCUGCGUGUUGUCUACUUdTdT | 996 | AAGUAGACAACACGCAGCCdTdT | 997 | GGCUGCGUGUUGUCUACUU | 998 |
| AD-77719 | UCCCCAAGAGGCUGCGUGUdTdT | 999 | ACACGCAGCCUCUUGGGGAdTdT | 1000 | UCCCCAAGAGGCUGCGUGU | 1001 |
| AD-77720 | UUCCGAAACCUGCGGCUCAdTdT | 1002 | UGAGCCGCAGGUUUCGGAAdTdT | 1003 | UUCCGAAACCUGCGGCUCC | 1004 |
| AD-77721 | CGUUGCAGCCGUCUUCCUUdTdT | 1005 | AAGGAAGACGGCUGCAACGdTdT | 1006 | CGUUGCAGCCGUCUUCCUU | 1007 |
| AD-77722 | CCCCACACCAUCACGUUGAdTdT | 1008 | UCAACGUGAUGGUGUGGGGdTdT | 1009 | CCCCACACCAUCACGUUGC | 1010 |
| AD-77723 | UGUGAGGCCGUCCACACCAdTdT | 1011 | UGGUGUGGACGGCCUCACAdTdT | 1012 | UGUGAGGCCGUCCACACCC | 1013 |
| AD-77724 | GGCAGCUGGCUGUGAGGCAdTdT | 1014 | UGCCUCACAGCCAGCUGCCdTdT | 1015 | GGCAGCUGGCUGUGAGGCC | 1016 |
| AD-77725 | CCAACGCGCUACGAGCGGAdTdT | 1017 | UCCGCUCGUAGCGCGUUGGdTdT | 1018 | CCAACGCGCUACGAGCGGC | 1019 |
| AD-77726 | CAAGCCAGUGGGACAGCCAdTdT | 1020 | UGGCUGUCCCACUGGCUUGdTdT | 1021 | CAAGCCAGUGGGACAGCCA | 1022 |
| AD-77727 | GCCUGCCUGCCCUCAGCCAdTdT | 1023 | UGGCUGAGGGCAGGCAGGCdTdT | 1024 | GCCUGCCUGCCCUCAGCCA | 1025 |
| AD-77728 | GCGACUGCCCCUGAGGCAdTdT | 1026 | UGCCUCAGGGGCAGUCGCdTdT | 1027 | GCGACUGCCCCUGAGGCC | 1028 |
| AD-77729 | UAGCAGACCUGAACAAGCAdTdT | 1029 | UGCUUGUUCAGGUCUGCUAdTdT | 1030 | UAGCAGACCUGAACAAGCG | 1031 |
| AD-77730 | CAUUCGCCGGAUGGAGCUAdTdT | 1032 | UAGCUCCAUCCGGCGAAUGdTdT | 1033 | CAUUCGCCGGAUGGAGCUA | 1034 |
| AD-77731 | ACUGUCCUGUCCAUUGACAdTdT | 1035 | UGUCAAUGGACAGGACAGUdTdT | 1036 | ACUGUCCUGUCCAUUGACA | 1037 |

TABLE 5-continued

SCAP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-77732 | UUCACCACUGUCCUGUCCAdTdT | 1038 | UGGACAGGACAGUGGUGAAdTdT | 1039 | UUCACCACUGUCCUGUCCA | 1040 |
| AD-77733 | UGUUUUUCACCACUGUCCUdTdT | 1041 | AGGACAGUGGUGAAAAACAdTdT | 1042 | UGUUUUUCACCACUGUCCU | 1043 |
| AD-77734 | UUCUUCCUUCAGAUGCUGUdTdT | 1044 | ACAGCAUCUGAAGGAAGAAdTdT | 1045 | UUCUUCCUUCAGAUGCUGU | 1046 |
| AD-77735 | UGGUGUCUGACUUCUUCCUdTdT | 1047 | AGGAAGAAGUCAGACACCAdTdT | 1048 | UGGUGUCUGACUUCUUCCU | 1049 |
| AD-77736 | UUUGCUGUCGUGGGGCUGAdTdT | 1050 | UCAGCCCCACGACAGCAAAdTdT | 1051 | UUUGCUGUCGUGGGGCUGG | 1052 |
| AD-77737 | UCUCUUUGCUGUCGUGGGAdTdT | 1053 | UCCCACGACAGCAAAGAGAdTdT | 1054 | UCUCUUUGCUGUCGUGGGG | 1055 |
| AD-77738 | CCAUCCAGGAGUUCUGUCUdTdT | 1056 | AGACAGAACUCCUGGAUGGdTdT | 1057 | CCAUCCAGGAGUUCUGUCU | 1058 |
| AD-77739 | UUCACCCUAGUGCCCGCCAdTdT | 1059 | UGGCGGGCACUAGGGUGAAdTdT | 1060 | UUCACCCUAGUGCCCGCCA | 1061 |
| AD-77740 | UCAUCCUCAUCGGCUACUUdTdT | 1062 | AAGUAGCCGAUGAGGAUGAdTdT | 1063 | UCAUCCUCAUCGGCUACUU | 1064 |
| AD-77741 | GCCACGGAGCUGGGCAUCAdTdT | 1065 | UGAUGCCCAGCUCCGUGGCdTdT | 1066 | GCCACGGAGCUGGGCAUCA | 1067 |
| AD-77742 | CAUCAUGAAGAACAUGGCAdTdT | 1068 | UGCCAUGUUCUUCAUGAUGdTdT | 1069 | CAUCAUGAAGAACAUGGCC | 1070 |

TABLE 6

SCAP Unmodified Sequences

| Duplex Name | Sense Sequence (5' to 3') | SEQ ID NO | Antisense Sequence (5' to 3') | SEQ ID NO | Position in NM_012235.3 |
|---|---|---|---|---|---|
| AD-77652 | GCGGGCACCCGGCGGCCAA | 1071 | UUGGCCGCCGGGUGCCCGC | 1072 | 17-35 |
| AD-77651 | AGGAGAGAGAGGGAGGGCA | 1073 | UGCCCUCCCUCUCUCUCCU | 1074 | 34-52 |
| AD-77650 | GCGCCACGCACCGGACUGA | 1075 | UCAGUCCGGUGCGUGGCGC | 1076 | 50-68 |
| AD-77649 | GCACGCCGCGCUCCGCCCA | 1077 | UGGGCGGAGCGCGGCGUGC | 1078 | 82-100 |
| AD-77648 | CCGCGCUCCGCCCCUGCUA | 1079 | UAGCAGGGGCGGAGCGCGG | 1080 | 87-105 |
| AD-77647 | UGCCGCCCCGUCGCCGCA | 1081 | UGCGGCGACGGGGGCGGCA | 1082 | 104-122 |
| AD-77646 | GCCGCCGCCGCCGCGCAA | 1083 | UUGCGGCGGCGGCGGCGGC | 1084 | 120-138 |
| AD-77645 | CCGCAGCUUGGGAGGUGCU | 1085 | AGCACCUCCCAAGCUGCGG | 1086 | 133-151 |
| AD-77644 | GCUGCCACCACAGGUACCU | 1087 | AGGUACCUGUGGUGGCAGC | 1088 | 149-167 |
| AD-77643 | UACCUGCACAUGUUGUUCU | 1089 | AGAACAACAUGUGCAGGUA | 1090 | 163-181 |
| AD-77642 | UUGUUCUUUGUCAGUGCUA | 1091 | UAGCACUGACAAAGAACAA | 1092 | 175-193 |
| AD-77641 | UGUCAAGUGUGUGCCAGGA | 1093 | UCCUGGCACACACUUGACA | 1094 | 192-210 |
| AD-77640 | GGUGAUCCAUGGUCACUUU | 1095 | AAAGUGACCAUGGAUCACC | 1096 | 209-227 |
| AD-77639 | UUCCGGGAUGGCAGCAAGA | 1097 | UCUUGCUGCCAUCCCGGAA | 1098 | 226-244 |
| AD-77638 | UUCGGCUGAGGAUGACCCU | 1099 | AGGGUCAUCCUCAGCCGAA | 1100 | 249-267 |
| AD-77637 | CCUGACUGAAAGGCUGCGU | 1101 | ACGCAGCCUUUCAGUCAGG | 1102 | 265-283 |
| AD-77636 | UACAACCAUGGGCUCCUCU | 1103 | AGAGGAGCCCAUGGUUGUA | 1104 | 305-323 |
| AD-77635 | UCUGUGCAUCCUAUCCCAU | 1105 | AUGGGAUAGGAUGCACAGA | 1106 | 321-339 |
| AD-77634 | AUCCUAUCCCAUCCCCAUA | 1107 | UAUGGGGAUGGGAUAGGAU | 1108 | 328-346 |
| AD-77633 | UCAUCCUCUUCACAGGGUU | 1109 | AACCCUGUGAAGAGGAUGA | 1110 | 345-363 |
| AD-77632 | UUCUGCAUCUUAGCCUGCU | 1111 | AGCAGGCUAAGAUGCAGAA | 1112 | 362-380 |

TABLE 6-continued

SCAP Unmodified Sequences

| Duplex Name | Sense Sequence (5' to 3') | SEQ ID NO | Antisense Sequence (5' to 3') | SEQ ID NO | Position in NM_012235.3 |
|---|---|---|---|---|---|
| AD-77631 | GCUGCUACCCACUGCUGAA | 1113 | UUCAGCAGUGGGUAGCAGC | 1114 | 378-396 |
| AD-77630 | UACCCACUGCUGAAACUCA | 1115 | UGAGUUUCAGCAGUGGGUA | 1116 | 383-401 |
| AD-77629 | CCUUGCCAGGAACAGGACA | 1117 | UGUCCUGUUCCUGGCAAGG | 1118 | 402-420 |
| AD-77628 | UGUGGAAUUCACCACCCCU | 1119 | AGGGGUGGUGAAUUCCACA | 1120 | 421-439 |
| AD-77627 | CCUGUGAAGGAUUACUCGA | 1121 | UCGAGUAAUCCUUCACAGG | 1122 | 437-455 |
| AD-77626 | UUACUCGCCCCCACCUGUA | 1123 | UACAGGUGGGGGCGAGUAA | 1124 | 448-466 |
| AD-77625 | CCACCUGUGGACUCUGACA | 1125 | UGUCAGAGUCCACAGGUGG | 1126 | 458-476 |
| AD-77624 | CCUACUGAGCAGCCUGAGU | 1127 | ACUCAGGCUGCUCAGUAGG | 1128 | 491-509 |
| AD-77623 | AGUGGUAUGUGGGUGCCCA | 1129 | UGGGCACCCACAUACCACU | 1130 | 507-525 |
| AD-77622 | CCCGGUGGCUUAUGUCCAA | 1131 | UUGGACAUAAGCCACCGGG | 1132 | 523-541 |
| AD-77621 | UUAUGUCCAGCAGAUAUUU | 1133 | AAAUAUCUGCUGGACAUAA | 1134 | 532-550 |
| AD-77620 | UGUGAAGUCCUCAGUGUUU | 1135 | AAACACUGAGGACUUCACA | 1136 | 550-568 |
| AD-77619 | UUCCCUGGCACAAGAACCU | 1137 | AGGUUCUUGUGCCAGGGAA | 1138 | 567-585 |
| AD-77618 | CCUCCUGGCAGUAGAUGUA | 1139 | UACAUCUACUGCCAGGAGG | 1140 | 583-601 |
| AD-77617 | GUAUUUCGUUCACCUUUGU | 1141 | ACAAAGGUGAACGAAAUAC | 1142 | 599-617 |
| AD-77616 | UCGUUCACCUUUGUCCCGA | 1143 | UCGGGACAAAGGUGAACGA | 1144 | 604-622 |
| AD-77615 | GGGCAUUCCAACUGGUGGA | 1145 | UCCACCAGUUGGAAUGCCC | 1146 | 621-639 |
| AD-77614 | GAGGAGAUCCGGAACCACA | 1147 | UGUGGUUCCGGAUCUCCUC | 1148 | 638-656 |
| AD-77613 | CGUGCUGAGAGACAGCUCU | 1149 | AGAGCUGUCUCUCAGCACG | 1150 | 655-673 |
| AD-77612 | GAGACAGCUCUGGGAUCAA | 1151 | UUGAUCCCAGAGCUGUCUC | 1152 | 663-681 |
| AD-77611 | AGGAGCUUGGAGGAGUUGU | 1153 | ACAACUCCUCCAAGCUCCU | 1154 | 680-698 |
| AD-77610 | UGUGUCUGCAAGUGACCGA | 1155 | UCGGUCACUUGCAGACACA | 1156 | 696-714 |
| AD-77609 | CGACCUGCUGCCAGGCCUU | 1157 | AAGGCCUGGCAGCAGGUCG | 1158 | 712-730 |
| AD-77608 | UUAGGAAGCUCAGGAACCU | 1159 | AGGUUCCUGAGCUUCCUAA | 1160 | 729-747 |
| AD-77607 | CCUACUCCCUGAGCAUGGA | 1161 | UCCAUGCUCAGGGAGUAGG | 1162 | 745-763 |
| AD-77606 | UCCCUGAGCAUGGAUGCCU | 1163 | AGGCAUCCAUGCUCAGGGA | 1164 | 750-768 |
| AD-77605 | CCUGCUGCUGUCCCCUGGA | 1165 | UCCAGGGGACAGCAGCAGG | 1166 | 766-784 |
| AD-77604 | CUGUCCCUGGGAACUUCU | 1167 | AGAAGUUCCCAGGGGACAG | 1168 | 773-791 |
| AD-77603 | UCUGGCAGAAUGACUGGGA | 1169 | UCCCAGUCAUUCUGCCAGA | 1170 | 789-807 |
| AD-77602 | AGAAUGACUGGGAACGCUU | 1171 | AAGCGUUCCCAGUCAUUCU | 1172 | 795-813 |
| AD-77601 | CUUCCAUGCUGAUCCUGAA | 1173 | UUCAGGAUCAGCAUGGAAG | 1174 | 811-829 |
| AD-77600 | GACAUCAUUGGGACCAUCA | 1175 | UGAUGGUCCCAAUGAUGUC | 1176 | 827-845 |
| AD-77599 | UCCACCAGCACGAGCCUAA | 1177 | UUAGGCUCGUGCUGGUGGA | 1178 | 843-861 |
| AD-77598 | CACGAGCCUAAAACCCUGA | 1179 | UCAGGGUUUUAGGCUCGUG | 1180 | 851-869 |
| AD-77597 | UGCAGACUUCAGCCACACU | 1181 | AGUGUGGCUGAAGUCUGCA | 1182 | 867-885 |
| AD-77596 | UCAGCCACACUCAAAGACU | 1183 | AGUCUUUGAGUGUGGCUGA | 1184 | 875-893 |
| AD-77595 | ACUUGUUAUUUGGUGUUCA | 1185 | UGAACACCAAAUAACAAGU | 1186 | 891-909 |
| AD-77594 | UACAGCGGGGUGAGCCUCU | 1187 | AGAGGCUCACCCCGCUGUA | 1188 | 917-935 |

TABLE 6-continued

SCAP Unmodified Sequences

| Duplex Name | Sense Sequence (5' to 3') | SEQ ID NO | Antisense Sequence (5' to 3') | SEQ ID NO | Position in NM_012235.3 |
|---|---|---|---|---|---|
| AD-77593 | UCUACACCAGGAAGAGGAU | 1189 | AUCCUCUUCCUGGUGUAGA | 1190 | 933-951 |
| AD-77592 | GGAAGAGGAUGGUCUCCUA | 1191 | UAGGAGACCAUCCUCUUCC | 1192 | 942-960 |
| AD-77591 | UACACCAUCACCCUGGUCU | 1193 | AGACCAGGGUGAUGGUGUA | 1194 | 959-977 |
| AD-77590 | UCUUCCAGCACUACCAUGA | 1195 | UCAUGGUAGUGCUGGAAGA | 1196 | 975-993 |
| AD-77589 | UGCCAAGUUCCUGGGCAGA | 1197 | UCUGCCCAGGAACUUGGCA | 1198 | 991-1009 |
| AD-77588 | UUCCUGGGCAGCCUGCGUA | 1199 | UACGCAGGCUGCCCAGGAA | 1200 | 998-1016 |
| AD-77587 | GUGCCCGCCUGAUGCUUCU | 1201 | AGAAGCAUCAGGCGGGCAC | 1202 | 1014-1032 |
| AD-77586 | UUCUGCACCCCAGCCCCAA | 1203 | UUGGGGCUGGGGUGCAGAA | 1204 | 1029-1047 |
| AD-77585 | ACUGCAGCCUUCGGGCGGA | 1205 | UCCGCCCGAAGGCUGCAGU | 1206 | 1047-1065 |
| AD-77584 | GAGAGCCUGGUCCACGUGA | 1207 | UCACGUGGACCAGGCUCUC | 1208 | 1064-1082 |
| AD-77583 | GCACUUCAAGGAGGAGAUU | 1209 | AAUCUCCUCCUUGAAGUGC | 1210 | 1081-1099 |
| AD-77582 | UUGGUGUCGCUGAGCUCAU | 1211 | AUGAGCUCAGCGACACCAA | 1212 | 1098-1116 |
| AD-77581 | CAUCCCCCUUGUGACCACA | 1213 | UGUGGUCACAAGGGGGAUG | 1214 | 1114-1132 |
| AD-77580 | GACCACCUACAUCAUCUUA | 1215 | UAAGAUGAUGUAGGUGGUC | 1216 | 1126-1144 |
| AD-77579 | UGUUUGCCUACAUCUACUU | 1217 | AAGUAGAUGUAGGCAAACA | 1218 | 1143-1161 |
| AD-77578 | UUCUCCACGCGGAAGAUCA | 1219 | UGAUCUUCCGCGUGGAGAA | 1220 | 1160-1178 |
| AD-77577 | UCGACAUGGUCAAGUCCAA | 1221 | UUGGACUUGACCAUGUCGA | 1222 | 1176-1194 |
| AD-77576 | CAAGUGGGGCUGGCCCUA | 1223 | UAGGGCCAGCCCCCACUUG | 1224 | 1192-1210 |
| AD-77575 | GGCCCUGGCUGCCGUGGUA | 1225 | UACCACGGCAGCCAGGGCC | 1226 | 1204-1222 |
| AD-77574 | UCACAGUGCUCAGCUCGCU | 1227 | AGCGAGCUGAGCACUGUGA | 1228 | 1221-1239 |
| AD-77573 | GCUGCUCAUGUCUGUGGGA | 1229 | UCCCACAGACAUGAGCAGC | 1230 | 1237-1255 |
| AD-77572 | CAUGUCUGUGGGACUCUGA | 1231 | UCAGAGUCCCACAGACAUG | 1232 | 1243-1261 |
| AD-77571 | UGCACACUCUUCGGCCUGA | 1233 | UCAGGCCGAAGAGUGUGCA | 1234 | 1259-1277 |
| AD-77570 | UUCGGCCUGACGCCCACCA | 1235 | UGGUGGGCGUCAGGCCGAA | 1236 | 1268-1286 |
| AD-77569 | CCUCAAUGGCGGCGAGAUU | 1237 | AAUCUCGCCGCCAUUGAGG | 1238 | 1285-1303 |
| AD-77568 | UUUUCCCUACCUUGUGGU | 1239 | ACCACAAGGUAGGGAAAA | 1240 | 1302-1320 |
| AD-77567 | GGUGGUUAUUGGGUUAGAA | 1241 | UUCUAACCCAAUAACCACC | 1242 | 1318-1336 |
| AD-77566 | UUAUUGGGUUAGAGAAUGU | 1243 | ACAUUCUCUAACCCAAUAA | 1244 | 1323-1341 |
| AD-77565 | AAGUCUGUGGUCUCAACCA | 1245 | UGGUUGAGACCACAGACUU | 1246 | 1355-1373 |
| AD-77564 | UCUCAACCCCGGUAGACCU | 1247 | AGGUCUACCGGGGUUGAGA | 1248 | 1365-1383 |
| AD-77563 | CCUGGAGGUGAAGCUGCGA | 1249 | UCGCAGCUUCACCUCCAGG | 1250 | 1381-1399 |
| AD-77562 | CUGCGGAUCGCCCAAGGCA | 1251 | UGCCUUGGGCGAUCCGCAG | 1252 | 1394-1412 |
| AD-77561 | CCUAAGCAGCGAGAGCUGA | 1253 | UCAGCUCUCGCUGCUUAGG | 1254 | 1411-1429 |
| AD-77742 | CAUCAUGAAGAACAUGGCA | 1255 | UGCCAUGUUCUUCAUGAUG | 1256 | 1432-1450 |
| AD-77741 | GCCACGGAGCUGGGCAUCA | 1257 | UGAUGCCCAGCUCCGUGGC | 1258 | 1448-1466 |
| AD-77740 | UCAUCCUCAUCGGCUACUU | 1259 | AAGUAGCCGAUGAGGAUGA | 1260 | 1464-1482 |
| AD-77739 | UUCACCCUAGUGCCCGCCA | 1261 | UGGCGGGCACUAGGGUGAA | 1262 | 1481-1499 |

TABLE 6-continued

SCAP Unmodified Sequences

| Duplex Name | Sense Sequence (5' to 3') | SEQ ID NO | Antisense Sequence (5' to 3') | SEQ ID NO | Position in NM_012235.3 |
|---|---|---|---|---|---|
| AD-77738 | CCAUCCAGGAGUUCUGUCU | 1263 | AGACAGAACUCCUGGAUGG | 1264 | 1497-1515 |
| AD-77737 | UCUCUUUGCUGUCGUGGGA | 1265 | UCCCACGACAGCAAAGAGA | 1266 | 1513-1531 |
| AD-77736 | UUUGCUGUCGUGGGGCUGA | 1267 | UCAGCCCCACGACAGCAAA | 1268 | 1517-1535 |
| AD-77735 | UGGUGUCUGACUUCUUCCU | 1269 | AGGAAGAAGUCAGACACCA | 1270 | 1533-1551 |
| AD-77734 | UUCUUCCUUCAGAUGCUGU | 1271 | ACAGCAUCUGAAGGAAGAA | 1272 | 1544-1562 |
| AD-77733 | UGUUUUUCACCACUGUCCU | 1273 | AGGACAGUGGUGAAAAACA | 1274 | 1560-1578 |
| AD-77732 | UUCACCACUGUCCUGUCCA | 1275 | UGGACAGGACAGUGGUGAA | 1276 | 1565-1583 |
| AD-77731 | ACUGUCCUGUCCAUUGACA | 1277 | UGUCAAUGGACAGGACAGU | 1278 | 1571-1589 |
| AD-77730 | CAUUCGCCGGAUGGAGCUA | 1279 | UAGCUCCAUCCGGCGAAUG | 1280 | 1588-1606 |
| AD-77729 | UAGCAGACCUGAACAAGCA | 1281 | UGCUUGUUCAGGUCUGCUA | 1282 | 1605-1623 |
| AD-77728 | GCGACUGCCCCUGAGGCA | 1283 | UGCCUCAGGGGCAGUCGC | 1284 | 1621-1639 |
| AD-77727 | GCCUGCCUGCCCUCAGCCA | 1285 | UGGCUGAGGGCAGGCAGGC | 1286 | 1637-1655 |
| AD-77726 | CAAGCCAGUGGGACAGCCA | 1287 | UGGCUGUCCCACUGGCUUG | 1288 | 1654-1672 |
| AD-77725 | CCAACGCGCUACGAGCGGA | 1289 | UCCGCUCGUAGCGCGUUGG | 1290 | 1670-1688 |
| AD-77724 | GGCAGCUGGCUGUGAGGCA | 1291 | UGCCUCACAGCCAGCUGCC | 1292 | 1686-1704 |
| AD-77723 | UGUGAGGCCGUCCACACCA | 1293 | UGGUGUGGACGGCCUCACA | 1294 | 1696-1714 |
| AD-77722 | CCCCACACCAUCACGUUGA | 1295 | UCAACGUGAUGGUGUGGGG | 1296 | 1712-1730 |
| AD-77721 | CGUUGCAGCCGUCUUCCUU | 1297 | AAGGAAGACGGCUGCAACG | 1298 | 1725-1743 |
| AD-77720 | UUCCGAAACCUGCGGCUCA | 1299 | UGAGCCGCAGGUUUCGGAA | 1300 | 1742-1760 |
| AD-77719 | UCCCCAAGAGGCUGCGUGU | 1301 | ACACGCAGCCUCUUGGGGA | 1302 | 1758-1776 |
| AD-77718 | GGCUGCGUGUUGUCUACUU | 1303 | AAGUAGACAACACGCAGCC | 1304 | 1767-1785 |
| AD-77717 | UUCCUGGCCCGCACCCGCA | 1305 | UGCGGGUGCGGGCCAGGAA | 1306 | 1784-1802 |
| AD-77716 | GCCUGGCACAGCGCCUCAU | 1307 | AUGAGGCGCUGUGCCAGGC | 1308 | 1800-1818 |
| AD-77715 | CAUCAUGGCUGGCACCGUU | 1309 | AACGGUGCCAGCCAUGAUG | 1310 | 1816-1834 |
| AD-77714 | UUGUCUGGAUUGGCAUCCU | 1311 | AGGAUGCCAAUCCAGACAA | 1312 | 1833-1851 |
| AD-77713 | CCUGGUAUACACAGACCCA | 1313 | UGGGUCUGUGUAUACCAGG | 1314 | 1849-1867 |
| AD-77712 | ACACAGACCCAGCAGGGCU | 1315 | AGCCCUGCUGGGUCUGUGU | 1316 | 1857-1875 |
| AD-77711 | GCUGCGCAACUACCUCGCU | 1317 | AGCGAGGUAGUUGCGCAGC | 1318 | 1873-1891 |
| AD-77710 | GCUGCCCAGGUGACGGAAA | 1319 | UUUCCGUCACCUGGGCAGC | 1320 | 1889-1907 |
| AD-77709 | CAGGUGACGGAACAGAGCA | 1321 | UGCUCUGUUCCGUCACCUG | 1322 | 1895-1913 |
| AD-77708 | CAUUGGGUGAGGGAGCCCU | 1323 | AGGGCUCCCUCACCCAAUG | 1324 | 1914-1932 |
| AD-77707 | CCUGGCUCCCAUGCCCGUA | 1325 | UACGGGCAUGGGAGCCAGG | 1326 | 1930-1948 |
| AD-77706 | GUGCCUAGUGGCAUGCUGA | 1327 | UCAGCAUGCCACUAGGCAC | 1328 | 1946-1964 |
| AD-77705 | UGCCCCCAGCCACCCGGA | 1329 | UCCGGGUGGCUGGGGGCA | 1330 | 1962-1980 |
| AD-77704 | CCAGCCACCCGGACCCUGA | 1331 | UCAGGGUCCGGGUGGCUGG | 1332 | 1968-1986 |
| AD-77703 | UGCCUUCUCCAUCUUCCCA | 1333 | UGGGAAGAUGGAGAAGGCA | 1334 | 1984-2002 |
| AD-77702 | UUCUCCAUCUUCCCACCUA | 1335 | UAGGUGGGAAGAUGGAGAA | 1336 | 1988-2006 |
| AD-77701 | CUGAUGCCCCUAAGCUACA | 1337 | UGUAGCUUAGGGGCAUCAG | 1338 | 2004-2022 |

TABLE 6-continued

SCAP Unmodified Sequences

| Duplex Name | Sense Sequence (5' to 3') | SEQ ID NO | Antisense Sequence (5' to 3') | SEQ ID NO | Position in NM_012235.3 |
|---|---|---|---|---|---|
| AD-77700 | UAAGCUACCUGAGAACCAA | 1339 | UUGGUUCUCAGGUAGCUUA | 1340 | 2014-2032 |
| AD-77699 | CAGACGUCGCCAGGCGAGU | 1341 | ACUCGCCUGGCGACGUCUG | 1342 | 2030-2048 |
| AD-77698 | AGUCACCUGAGCGUGGAGA | 1343 | UCUCCACGCUCAGGUGACU | 1344 | 2046-2064 |
| AD-77697 | AGGUCCAGCAGAGGUUGUA | 1345 | UACAACCUCUGCUGGACCU | 1346 | 2062-2080 |
| AD-77696 | UUGUCCAUGACAGCCCAGU | 1347 | ACUGGGCUGUCAUGGACAA | 1348 | 2076-2094 |
| AD-77695 | AGUCCCAGAGGUAACCUGA | 1349 | UCAGGUUACCUCUGGGACU | 1350 | 2092-2110 |
| AD-77694 | CUGGGGGCCUGAGGAUGAA | 1351 | UUCAUCCUCAGGCCCCCAG | 1352 | 2107-2125 |
| AD-77693 | AGGAACUUUGGAGGAAAUU | 1353 | AAUUUCCUCCAAAGUUCCU | 1354 | 2124-2142 |
| AD-77692 | AUUGUCCUUCCGCCACUGA | 1355 | UCAGUGGCGGAAGGACAAU | 1356 | 2140-2158 |
| AD-77691 | UCCGCCACUGGCCGACGCU | 1357 | AGCGUCGGCCAGUGGCGGA | 1358 | 2148-2166 |
| AD-77690 | CGACGCUCUUCAGCUAUUA | 1359 | UAAUAGCUGAAGAGCGUCG | 1360 | 2160-2178 |
| AD-77689 | UACAACAUCACACUGGCCA | 1361 | UGGCCAGUGUGAUGUUGUA | 1362 | 2177-2195 |
| AD-77688 | CCAAGAGGUACAUCAGCCU | 1363 | AGGCUGAUGUACCUCUUGG | 1364 | 2193-2211 |
| AD-77687 | UACAUCAGCCUGCUGCCCA | 1365 | UGGGCAGCAGGCUGAUGUA | 1366 | 2201-2219 |
| AD-77686 | CCGUCAUCCCAGUCACGCU | 1367 | AGCGUGACUGGGAUGACGG | 1368 | 2217-2235 |
| AD-77685 | GCUCCGCCUGAACCCGAGA | 1369 | UCUCGGGUUCAGGCGGAGC | 1370 | 2233-2251 |
| AD-77684 | GCUCUGGAGGGCCGGCACA | 1371 | UGUGCCGGCCCUCCAGAGC | 1372 | 2255-2273 |
| AD-77683 | ACCCUCAGGACGGCCGCAA | 1373 | UUGCGGCCGUCCUGAGGGU | 1374 | 2271-2289 |
| AD-77682 | CCACCGGGGCCCAUACCUA | 1375 | UAGGUAUGGGCCCCGGUGG | 1376 | 2300-2318 |
| AD-77681 | UGCUGGGCACUGGGAAGCA | 1377 | UGCUUCCCAGUGCCCAGCA | 1378 | 2317-2335 |
| AD-77680 | CAGGACCCAAGGGCCCAGA | 1379 | UCUGGGCCCUUGGGUCCUG | 1380 | 2334-2352 |
| AD-77679 | AGGUGGGGUGCAGGCCCAU | 1381 | AUGGGCCUGCACCCCACCU | 1382 | 2350-2368 |
| AD-77678 | CAGGCCCAUGGAGACGUCA | 1383 | UGACGUCUCCAUGGGCCUG | 1384 | 2360-2378 |
| AD-77677 | UCACGCUGUACAAGGUGGA | 1385 | UCCACCUUGUACAGCGUGA | 1386 | 2376-2394 |
| AD-77676 | UGUACAAGGUGGCGGCGCU | 1387 | AGCGCCGCCACCUUGUACA | 1388 | 2382-2400 |
| AD-77675 | GCUGGGCCUGGCCACCGGA | 1389 | UCCGGUGGCCAGGCCCAGC | 1390 | 2398-2416 |
| AD-77674 | UGGCCACCGGCAUCGUCUU | 1391 | AAGACGAUGCCGGUGGCCA | 1392 | 2406-2424 |
| AD-77673 | UCUGCCUCUACCGCGUGCU | 1393 | AGCACGCGGUAGAGGCAGA | 1394 | 2439-2457 |
| AD-77672 | GCUAUGCCCGCGCAACUAA | 1395 | UUAGUUGCGCGGGCAUAGC | 1396 | 2455-2473 |
| AD-77671 | CGCAACUACGGGCAGCUGA | 1397 | UCAGCUGCCCGUAGUUGCG | 1398 | 2465-2483 |
| AD-77670 | CGGAGGCGCGGGGAGCUGA | 1399 | UCAGCUCCCCGCGCCUCCG | 1400 | 2501-2519 |
| AD-77669 | UGCCCUGCGACGACUACGA | 1401 | UCGUAGUCGUCGCAGGGCA | 1402 | 2517-2535 |
| AD-77668 | UACGGCUAUGCGCCACCCA | 1403 | UGGGUGGCGCAUAGCCGUA | 1404 | 2531-2549 |
| AD-77667 | CCGAGACGGAGAUCGUGCA | 1405 | UGCACGAUCUCCGUCUCGG | 1406 | 2547-2565 |
| AD-77666 | GACGGAGAUCGUGCCGCUU | 1407 | AAGCGGCACGAUCUCCGUC | 1408 | 2551-2569 |
| AD-77665 | UUGUGCUGCGCGGCCACCU | 1409 | AGGUGGCCGCGCAGCACAA | 1410 | 2568-2586 |
| AD-77664 | CCUCAUGGACAUCGAGUGA | 1411 | UCACUCGAUGUCCAUGAGG | 1412 | 2584-2602 |

TABLE 6-continued

SCAP Unmodified Sequences

| Duplex Name | Sense Sequence (5' to 3') | SEQ ID NO | Antisense Sequence (5' to 3') | SEQ ID NO | Position in NM_012235.3 |
|---|---|---|---|---|---|
| AD-77663 | UGCCUGGCCAGCGACGGCA | 1413 | UGCCGUCGCUGGCCAGGCA | 1414 | 2600-2618 |
| AD-77662 | GCAUGCUGCUGGUGAGCUA | 1415 | UAGCUCACCAGCAGCAUGC | 1416 | 2616-2634 |
| AD-77661 | UCUGCGUGUGGGACGCGCA | 1417 | UGCGCGUCCCACACGCAGA | 1418 | 2652-2670 |
| AD-77660 | GACGCGCAGACCGGGGAUU | 1419 | AAUCCCCGGUCUGCGCGUC | 1420 | 2663-2681 |
| AD-77659 | UUGCCUAACGCGCAUUCCA | 1421 | UGGAAUGCGCGUUAGGCAA | 1422 | 2680-2698 |
| AD-77658 | CCGCGCCCAGGCAGGCAGA | 1423 | UCUGCCUGCCUGGGCGCGG | 1424 | 2696-2714 |
| AD-77657 | AGCGCCGGGACAGUGGCGU | 1425 | ACGCCACUGUCCCGGCGCU | 1426 | 2712-2730 |
| AD-77656 | CGGGACAGUGGCGUGGGCA | 1427 | UGCCCACGCCACUGUCCCG | 1428 | 2717-2735 |
| AD-77655 | CAGCGGGCUUGAGGCUCAA | 1429 | UUGAGCCUCAAGCCCGCUG | 1430 | 2734-2752 |
| AD-77654 | AGGAGAGCUGGGAACGACU | 1431 | AGUCGUUCCCAGCUCUCCU | 1432 | 2751-2769 |
| AD-77653 | UUCAGAUGGUGGGAAGGCU | 1433 | AGCCUUCCCACCAUCUGAA | 1434 | 2770-2788 |
| AD-77558 | CCUCCCCUGAGACACCGCA | 1435 | UGCGGUGUCUCAGGGGAGG | 1436 | 2813-2831 |
| AD-77557 | CUCCGCCGCCUUCCCUCUU | 1437 | AAGAGGGAAGGCGGCGGAG | 1438 | 2841-2859 |
| AD-77556 | UUCGGGGACCAGCCUGACA | 1439 | UGUCAGGCUGGUCCCCGAA | 1440 | 2858-2876 |
| AD-77555 | ACCUCACCUGCUUAAUUGA | 1441 | UCAAUUAAGCAGGUGAGGU | 1442 | 2874-2892 |
| AD-77554 | UUAAUUGACACCAACUUUU | 1443 | AAAAGUUGGUGUCAAUUAA | 1444 | 2885-2903 |
| AD-77553 | UUUCAGCGCAGCCUCGGUA | 1445 | UACCGAGGCUGCGCUGAAA | 1446 | 2901-2919 |
| AD-77552 | GUCCUCACAGCCCACUCAA | 1447 | UUGAGUGGGCUGUGAGGAC | 1448 | 2917-2935 |
| AD-77551 | CAGCCCGAGCCCCGGCACA | 1449 | UGUGCCGGGGCUCGGGCUG | 1450 | 2933-2951 |
| AD-77550 | CCGGCACCGGGCGGUCUGU | 1451 | ACAGACCGCCCGGUGCCGG | 1452 | 2944-2962 |
| AD-77549 | UGUGGCCGCUCUCGGGACU | 1453 | AGUCCCGAGAGCGGCCACA | 1454 | 2960-2978 |
| AD-77548 | UCUCGGGACUCCCCAGGCU | 1455 | AGCCUGGGGAGUCCCGAGA | 1456 | 2969-2987 |
| AD-77547 | CUGCCUGGUGCAGCGGGUA | 1457 | UACCCGCUGCACCAGGCAG | 1458 | 2998-3016 |
| AD-77546 | UGUACCAGGAGGAGGGGCU | 1459 | AGCCCCUCCUCCUGGUACA | 1460 | 3015-3033 |
| AD-77545 | GCUGGCGGCCGUCUGCACA | 1461 | UGUGCAGACGGCCGCCAGC | 1462 | 3031-3049 |
| AD-77544 | CCAGCCCUGCGCCCACCCU | 1463 | AGGGUGGGCGCAGGGCUGG | 1464 | 3050-3068 |
| AD-77543 | CCUCGCCUGGGCCGGUGCU | 1465 | AGCACCGGCCCAGGCGAGG | 1466 | 3066-3084 |
| AD-77542 | CGGUGCUGUCCCAGGCCCA | 1467 | UGGGCCUGGGACAGCACCG | 1468 | 3078-3096 |
| AD-77541 | CCUGAGGACGAGGGUGGCU | 1469 | AGCCACCCUCGUCCUCAGG | 1470 | 3095-3113 |
| AD-77540 | GCUCCCCGAGAAAGGCUA | 1471 | UAGCCUUUCUCGGGGAGC | 1472 | 3111-3129 |
| AD-77539 | CCCGAGAAAGGCUCCCCUU | 1473 | AAGGGGAGCCUUUCUCGGG | 1474 | 3116-3134 |
| AD-77538 | UUCCCUCGCCUGGGCCCCA | 1475 | UGGGGCCCAGGCGAGGGAA | 1476 | 3133-3151 |
| AD-77537 | CCCAGUGCCGAGGGUUCCA | 1477 | UGGAACCCUCGGCACUGGG | 1478 | 3149-3167 |
| AD-77536 | AGGGUUCCAUCUGGAGCUU | 1479 | AAGCUCCAGAUGGAACCCU | 1480 | 3159-3177 |
| AD-77535 | UUGGAGCUGCAGGGCAACA | 1481 | UGUUGCCCUGCAGCUCCAA | 1482 | 3176-3194 |
| AD-77534 | ACCUCAUCGUGGUGGGCA | 1483 | UGCCCCACCACGAUGAGGU | 1484 | 3192-3210 |
| AD-77533 | GCGGAGCAGCGGCCGGCUA | 1485 | UAGCCGGCCGCUGCUCCGC | 1486 | 3208-3226 |
| AD-77532 | ACGCCAUUGAAGGGGUGCU | 1487 | AGCACCCCUUCAAUGGCGU | 1488 | 3237-3255 |

TABLE 6-continued

SCAP Unmodified Sequences

| Duplex Name | Sense Sequence (5' to 3') | SEQ ID NO | Antisense Sequence (5' to 3') | SEQ ID NO | Position in NM_012235.3 |
|---|---|---|---|---|---|
| AD-77531 | UGCAGCAGCGAGGAGGUCU | 1489 | AGACCUCCUCGCUGCUGCA | 1490 | 3260-3278 |
| AD-77530 | UCUCCUCAGGCAUUACCGA | 1491 | UCGGUAAUGCCUGAGGAGA | 1492 | 3276-3294 |
| AD-77529 | CGCUCUGGUGUUCUUGGAA | 1493 | UUCCAAGAACACCAGAGCG | 1494 | 3292-3310 |
| AD-77528 | UUCUUGGACAAAAGGAUUA | 1495 | UAAUCCUUUUGUCCAAGAA | 1496 | 3302-3320 |
| AD-77527 | UGCACGGCUCAACGGUUCA | 1497 | UGAACCGUUGAGCCGUGCA | 1498 | 3325-3343 |
| AD-77526 | CCCUUGAUUUCUUCUCCUU | 1499 | AAGGAGAAGAAAUCAAGGG | 1500 | 3342-3360 |
| AD-77525 | UUGGAGACCCACACUGCCA | 1501 | UGGCAGUGUGGGUCUCCAA | 1502 | 3359-3377 |
| AD-77524 | CCCUCAGCCCCUGCAGUU | 1503 | AACUGCAGGGGCUGAGGG | 1504 | 3375-3393 |
| AD-77523 | UUAGAGGGACCCCAGGGCA | 1505 | UGCCCUGGGGUCCCUCUAA | 1506 | 3393-3411 |
| AD-77522 | GCGGGGCAGUUCCCCUGCA | 1507 | UGCAGGGGAACUGCCCCGC | 1508 | 3409-3427 |
| AD-77521 | CCCCUGCCUCUCCAGUGUA | 1509 | UACACUGGAGAGGCAGGGG | 1510 | 3420-3438 |
| AD-77520 | UACAGCAGCAGCGACACAA | 1511 | UUGUGUCGCUGCUGCUGUA | 1512 | 3437-3455 |
| AD-77519 | GACCCACACAGUGCCCUGU | 1513 | ACAGGGCACUGUGUGGGUC | 1514 | 3469-3487 |
| AD-77518 | AGUGCCCUGUGCACACCAA | 1515 | UUGGUGUGCACAGGGCACU | 1516 | 3478-3496 |
| AD-77517 | AAAAACCCAUCACAGCCCU | 1517 | AGGGCUGUGAUGGGUUUUU | 1518 | 3495-3513 |
| AD-77516 | CCUGAAAGCCGCUGCUGGA | 1519 | UCCAGCAGCGGCUUUCAGG | 1520 | 3511-3529 |
| AD-77515 | GGGCGCUUGGUGACUGGGA | 1521 | UCCCAGUCACCAAGCGCCC | 1522 | 3527-3545 |
| AD-77514 | UUGGUGACUGGGAGCCAAA | 1523 | UUUGGCUCCCAGUCACCAA | 1524 | 3533-3551 |
| AD-77513 | AAGACCACACACUGAGAGU | 1525 | ACUCUCAGUGUGUGGUCUU | 1526 | 3549-3567 |
| AD-77512 | AGUGUUCCGUCUGGAGGAA | 1527 | UUCCUCCAGACGGAACACU | 1528 | 3565-3583 |
| AD-77511 | UUCCGUCUGGAGGACUCGU | 1529 | ACGAGUCCUCCAGACGGAA | 1530 | 3569-3587 |
| AD-77510 | AGGACUCGUGCUGCCUCUU | 1531 | AAGAGGCAGCACGAGUCCU | 1532 | 3579-3597 |
| AD-77509 | UUCACCCUUCAGGGCCACU | 1533 | AGUGGCCCUGAAGGGUGAA | 1534 | 3596-3614 |
| AD-77508 | ACUCAGGGGCCAUCACGAA | 1535 | UUCGUGAUGGCCCCUGAGU | 1536 | 3612-3630 |
| AD-77507 | CAUCACGACCGUGUACAUU | 1537 | AAUGUACACGGUCGUGAUG | 1538 | 3622-3640 |
| AD-77506 | AUGGUGCUGGCCAGUGGAA | 1539 | UUCCACUGGCCAGCACCAU | 1540 | 3650-3668 |
| AD-77505 | AGGACAAGAUGGGGCCAUA | 1541 | UAUGGCCCCAUCUUGUCCU | 1542 | 3667-3685 |
| AD-77504 | UCUGCCUGUGGGAUGUACU | 1543 | AGUACAUCCCACAGGCAGA | 1544 | 3684-3702 |
| AD-77503 | AGCCGGGUCAGCCAUGUGU | 1545 | ACACAUGGCUGACCCGGCU | 1546 | 3710-3728 |
| AD-77502 | UUGCUCACCGUGGGGAUGU | 1547 | ACAUCCCCACGGUGAGCAA | 1548 | 3729-3747 |
| AD-77501 | GGGGAUGUCACCUCCCUUA | 1549 | UAAGGGAGGUGACAUCCCC | 1550 | 3740-3758 |
| AD-77500 | UACCUGUACCACCUCCUGU | 1551 | ACAGGAGGUGGUACAGGUA | 1552 | 3757-3775 |
| AD-77499 | CCUGUGUCAUCAGCAGUGA | 1553 | UCACUGCUGAUGACACAGG | 1554 | 3771-3789 |
| AD-77498 | GGCCGGAUGACCUCAUCA | 1555 | UGAUGAGGUCAUCCAGGCC | 1556 | 3788-3806 |
| AD-77497 | CAGCAUCUGGGACCGCAGA | 1557 | UCUGCGGUCCCAGAUGCUG | 1558 | 3805-3823 |
| AD-77496 | GCACAGGCAUCAAGUUCUA | 1559 | UAGAACUUGAUGCCUGUGC | 1560 | 3822-3840 |
| AD-77495 | ACCUGGGCUGUGGUGCAAA | 1561 | UUUGCACCACAGCCCAGGU | 1562 | 3855-3873 |

TABLE 6-continued

SCAP Unmodified Sequences

| Duplex Name | Sense Sequence (5' to 3') | SEQ ID NO | Antisense Sequence (5' to 3') | SEQ ID NO | Position in NM_012235.3 |
|---|---|---|---|---|---|
| AD-77494 | AAGCUUGGGUGUCAUCUCA | 1563 | UGAGAUGACACCCAAGCUU | 1564 | 3871-3889 |
| AD-77493 | UUGGGUGUCAUCUCAGACA | 1565 | UGUCUGAGAUGACACCCAA | 1566 | 3875-3893 |
| AD-77492 | ACAACCUGCUGGUGACUGA | 1567 | UCAGUCACCAGCAGGUUGU | 1568 | 3891-3909 |
| AD-77491 | GACUGGCGGCCAGGGCUGU | 1569 | ACAGCCCUGGCCGCCAGUC | 1570 | 3904-3922 |
| AD-77490 | GUGUCUCCUUUUGGGACCU | 1571 | AGGUCCCAAAAGGAGACAC | 1572 | 3921-3939 |
| AD-77489 | UGUUACAGACAGUCUACCU | 1573 | AGGUAGACUGUCUGUAACA | 1574 | 3954-3972 |
| AD-77488 | CCUGGGGAAGAACAGUGAA | 1575 | UUCACUGUUCUUCCCCAGG | 1576 | 3970-3988 |
| AD-77487 | GAGGCCCAGCCUGCCCGCA | 1577 | UGCGGGCAGGCUGGGCCUC | 1578 | 3986-4004 |
| AD-77486 | GCCAGAUCCUGGUGCUGGA | 1579 | UCCAGCACCAGGAUCUGGC | 1580 | 4002-4020 |
| AD-77485 | CUGGUGCUGGACAACGCUA | 1581 | UAGCGUUGUCCAGCACCAG | 1582 | 4010-4028 |
| AD-77484 | UGCCAUUGUCUGCAACUUU | 1583 | AAAGUUGCAGACAAUGGCA | 1584 | 4027-4045 |
| AD-77483 | CUCUGUGCUGGAGAAGCUA | 1585 | UAGCUUCUCCAGCACAGAG | 1586 | 4075-4093 |
| AD-77482 | UGGACUGAGCGCAGGGCCU | 1587 | AGGCCCUGCGCUCAGUCCA | 1588 | 4092-4110 |
| AD-77481 | CCUCCUUGCCCAGGCAGGA | 1589 | UCCUGCCUGGGCAAGGAGG | 1590 | 4108-4126 |
| AD-77480 | UUGCCCAGGCAGGAGGCUA | 1591 | UAGCCUCCUGCCUGGGCAA | 1592 | 4113-4131 |
| AD-77479 | CUGGGGUGCUGUGUGGGA | 1593 | UCCCCACACAGCACCCCAG | 1594 | 4129-4147 |
| AD-77478 | GGGCCAAUGCACUGAACCU | 1595 | AGGUUCAGUGCAUUGGCCC | 1596 | 4145-4163 |
| AD-77477 | CAAUGCACUGAACCUGGAA | 1597 | UUCCAGGUUCAGUGCAUUG | 1598 | 4149-4167 |
| AD-77476 | UUGGGGGAAAGAGCCGAGU | 1599 | ACUCGGCUCUUUCCCCCAA | 1600 | 4168-4186 |
| AD-77475 | AGUAUCUUCCAGCCGCUGA | 1601 | UCAGCGGCUGGAAGAUACU | 1602 | 4184-4202 |
| AD-77474 | CGCUGCCUCCUGACUGUAA | 1603 | UUACAGUCAGGAGGCAGCG | 1604 | 4197-4215 |
| AD-77473 | AAUAAUAUUAAACUUUUUU | 1605 | AAAAAAGUUUAAUAUUAUU | 1606 | 4214-4232 |
| AD-77472 | UUAAAAAACCAUAUCAUCA | 1607 | UGAUGAUAUGGUUUUUUAA | 1608 | 4231-4249 |
| AD-77471 | UCAUCUGUCAGGCACUUUA | 1609 | UAAAGUGCCUGACAGAUGA | 1610 | 4247-4265 |

TABLE 7

SCAP in vitro 10 nM screen
Table 7 below presents the results of a SCAP Single Dose (10 nM) Screen in Hep3b hepatocytes. Data are expressed as percent message remaining relative to AD-1955 non-targeting control.

| Duplex Name | 10 nM AVG |
|---|---|
| AD-77652 | 98.5 |
| AD-77651 | 96.7 |
| AD-77650 | 66.6 |
| AD-77649 | 80.9 |
| AD-77648 | 83.9 |
| AD-77647 | 76.0 |
| AD-77646 | 81.1 |
| AD-77645 | 73.3 |
| AD-77644 | 63.9 |
| AD-77643 | 120.8 |
| AD-77642 | 48.0 |
| AD-77641 | 55.0 |
| AD-77640 | 26.2 |
| AD-77639 | 95.3 |
| AD-77638 | 72.9 |
| AD-77637 | 74.5 |
| AD-77636 | 79.8 |
| AD-77635 | 43.0 |
| AD-77634 | 25.4 |
| AD-77633 | 24.2 |
| AD-77632 | 80.0 |
| AD-77631 | 22.7 |
| AD-77630 | 19.6 |
| AD-77629 | 23.5 |
| AD-77628 | 61.6 |
| AD-77627 | 14.9 |
| AD-77626 | 39.2 |
| AD-77625 | 18.6 |
| AD-77624 | 21.5 |
| AD-77623 | 53.8 |

TABLE 7-continued

SCAP in vitro 10 nM screen
Table 7 below presents the results of a SCAP Single Dose (10 nM) Screen in Hep3b hepatocytes. Data are expressed as percent message remaining relative to AD-1955 non-targeting control.

| Duplex Name | 10 nM AVG |
| --- | --- |
| AD-77622 | 34.2 |
| AD-77621 | 35.3 |
| AD-77620 | 28.4 |
| AD-77619 | 98.1 |
| AD-77618 | 31.9 |
| AD-77617 | 25.9 |
| AD-77616 | 50.6 |
| AD-77615 | 50.9 |
| AD-77614 | 30.6 |
| AD-77613 | 36.0 |
| AD-77612 | 34.8 |
| AD-77611 | 58.2 |
| AD-77610 | 41.2 |
| AD-77609 | 71.1 |
| AD-77608 | 130.3 |
| AD-77607 | 33.0 |
| AD-77606 | 77.5 |
| AD-77605 | 33.2 |
| AD-77604 | 30.4 |
| AD-77603 | 55.2 |
| AD-77602 | 28.9 |
| AD-77601 | 36.1 |
| AD-77600 | 75.3 |
| AD-77599 | 31.3 |
| AD-77598 | 32.8 |
| AD-77597 | 59.9 |
| AD-77596 | 31.7 |
| AD-77595 | 26.8 |
| AD-77594 | 78.4 |
| AD-77593 | 87.4 |
| AD-77592 | 32.5 |
| AD-77591 | 63.9 |
| AD-77590 | 28.1 |
| AD-77589 | 45.3 |
| AD-77588 | 52.0 |
| AD-77587 | 19.8 |
| AD-77586 | 29.5 |
| AD-77585 | 61.3 |
| AD-77584 | 52.3 |
| AD-77583 | 27.9 |
| AD-77582 | 34.1 |
| AD-77581 | 34.7 |
| AD-77580 | 38.0 |
| AD-77579 | 28.4 |
| AD-77578 | 28.1 |
| AD-77577 | 42.0 |
| AD-77576 | 55.6 |
| AD-77575 | 28.8 |
| AD-77574 | 73.5 |
| AD-77573 | 20.4 |
| AD-77572 | 21.5 |
| AD-77571 | 27.7 |
| AD-77570 | 47.0 |
| AD-77569 | 28.2 |
| AD-77568 | 67.4 |
| AD-77567 | 19.1 |
| AD-77566 | 59.2 |
| AD-77565 | 51.1 |
| AD-77564 | 58.6 |
| AD-77563 | 34.4 |
| AD-77562 | 40.0 |
| AD-77561 | 34.8 |
| AD-77742 | 39.6 |
| AD-77741 | 42.1 |
| AD-77740 | 32.0 |
| AD-77739 | 116.0 |
| AD-77738 | 20.9 |
| AD-77737 | 36.0 |
| AD-77736 | 82.0 |
| AD-77735 | 27.2 |
| AD-77734 | 96.9 |
| AD-77733 | 58.0 |
| AD-77732 | 53.0 |
| AD-77731 | 19.0 |
| AD-77730 | 21.9 |
| AD-77729 | 20.6 |
| AD-77728 | 39.5 |
| AD-77727 | 76.9 |
| AD-77726 | 106.9 |
| AD-77725 | 26.4 |
| AD-77724 | 54.9 |
| AD-77723 | 70.1 |
| AD-77722 | 31.5 |
| AD-77721 | 16.7 |
| AD-77720 | 29.4 |
| AD-77719 | 48.2 |
| AD-77718 | 16.6 |
| AD-77717 | 99.1 |
| AD-77716 | 43.1 |
| AD-77715 | 26.8 |
| AD-77714 | 124.5 |
| AD-77713 | 52.8 |
| AD-77712 | 88.4 |
| AD-77711 | 48.9 |
| AD-77710 | 33.4 |
| AD-77709 | 32.1 |
| AD-77708 | 125.4 |
| AD-77707 | 123.5 |
| AD-77706 | 22.6 |
| AD-77705 | 121.5 |
| AD-77704 | 26.3 |
| AD-77703 | 32.4 |
| AD-77702 | 81.5 |
| AD-77701 | 19.6 |
| AD-77700 | 27.0 |
| AD-77699 | 51.6 |
| AD-77698 | 36.2 |
| AD-77697 | 36.8 |
| AD-77696 | 129.2 |
| AD-77695 | 37.0 |
| AD-77694 | 41.0 |
| AD-77693 | 38.6 |
| AD-77692 | 56.2 |
| AD-77691 | 102.5 |
| AD-77690 | 18.7 |
| AD-77689 | 68.7 |
| AD-77688 | 21.5 |
| AD-77687 | 50.2 |
| AD-77686 | 16.3 |
| AD-77685 | 38.0 |
| AD-77684 | 123.1 |
| AD-77683 | 104.0 |
| AD-77682 | 63.6 |
| AD-77681 | 91.8 |
| AD-77680 | 86.1 |
| AD-77679 | 51.4 |
| AD-77678 | 39.2 |
| AD-77677 | 70.0 |
| AD-77676 | 99.4 |
| AD-77675 | 72.2 |
| AD-77674 | 45.1 |
| AD-77673 | 94.9 |
| AD-77672 | 31.5 |
| AD-77671 | 47.3 |
| AD-77670 | 62.9 |
| AD-77669 | 22.5 |
| AD-77668 | 73.7 |
| AD-77667 | 22.5 |
| AD-77666 | 28.6 |
| AD-77665 | 81.3 |
| AD-77664 | 41.9 |
| AD-77663 | 79.1 |
| AD-77662 | 25.0 |
| AD-77661 | 79.2 |
| AD-77660 | 24.7 |
| AD-77659 | 82.0 |

TABLE 7-continued

SCAP in vitro 10 nM screen
Table 7 below presents the results of a SCAP Single Dose (10 nM)
Screen in Hep3b hepatocytes. Data are expressed as percent
message remaining relative to AD-1955 non-targeting control.

| Duplex Name | 10 nM AVG |
|---|---|
| AD-77658 | 74.0 |
| AD-77657 | 73.5 |
| AD-77656 | 33.3 |
| AD-77655 | 24.7 |
| AD-77654 | 10.8 |
| AD-77653 | 75.2 |
| AD-77558 | 63.2 |
| AD-77557 | 50.5 |
| AD-77556 | 57.6 |
| AD-77555 | 9.7 |
| AD-77554 | 27.2 |
| AD-77553 | 60.1 |
| AD-77552 | 27.0 |
| AD-77551 | 119.8 |
| AD-77550 | 115.2 |
| AD-77549 | 99.5 |
| AD-77548 | 134.7 |
| AD-77547 | 23.4 |
| AD-77546 | 108.5 |
| AD-77545 | 38.4 |
| AD-77544 | 147.7 |
| AD-77543 | 123.0 |
| AD-77542 | 129.3 |
| AD-77541 | 85.6 |
| AD-77540 | 50.0 |
| AD-77539 | 54.1 |
| AD-77538 | 92.3 |
| AD-77537 | 59.2 |
| AD-77536 | 108.2 |
| AD-77535 | 102.2 |
| AD-77534 | 32.2 |
| AD-77533 | 44.2 |
| AD-77532 | 58.5 |
| AD-77531 | 80.1 |
| AD-77530 | 25.6 |
| AD-77529 | 20.2 |
| AD-77528 | 45.3 |
| AD-77527 | 26.3 |
| AD-77526 | 25.2 |
| AD-77525 | 59.2 |
| AD-77524 | 34.8 |
| AD-77523 | 87.9 |
| AD-77522 | 113.3 |
| AD-77521 | 20.1 |
| AD-77520 | 45.8 |
| AD-77519 | 31.5 |
| AD-77518 | 23.0 |
| AD-77517 | 57.8 |
| AD-77516 | 49.8 |
| AD-77515 | 35.0 |
| AD-77514 | 22.2 |
| AD-77513 | 25.3 |
| AD-77512 | 21.4 |
| AD-77511 | 94.6 |
| AD-77510 | 23.6 |
| AD-77509 | 133.2 |
| AD-77508 | 42.0 |
| AD-77507 | 20.8 |
| AD-77506 | 43.3 |
| AD-77505 | 20.6 |
| AD-77504 | 83.3 |
| AD-77503 | 32.5 |
| AD-77502 | 100.3 |
| AD-77501 | 70.9 |
| AD-77500 | 50.1 |
| AD-77499 | 26.5 |
| AD-77498 | 32.5 |
| AD-77497 | 45.9 |
| AD-77496 | 28.9 |
| AD-77495 | 35.5 |
| AD-77494 | 24.4 |
| AD-77493 | 54.3 |
| AD-77492 | 17.3 |
| AD-77491 | 24.0 |
| AD-77490 | 29.9 |
| AD-77489 | 49.9 |
| AD-77488 | 33.4 |
| AD-77487 | 66.5 |
| AD-77486 | 18.1 |
| AD-77485 | 32.0 |
| AD-77484 | 35.5 |
| AD-77483 | 18.6 |
| AD-77482 | 354.5 |
| AD-77481 | 86.8 |
| AD-77480 | 80.7 |
| AD-77479 | 26.4 |
| AD-77478 | 16.2 |
| AD-77477 | 16.2 |
| AD-77476 | 28.1 |
| AD-77475 | 11.1 |
| AD-77474 | 14.6 |
| AD-77473 | 76.3 |
| AD-77472 | 92.1 |
| AD-77471 | 112.9 |
| AD-1955 Avg | 100.1 |

SEQUENCE LISTING (1610 sequences)

SEQ ID NO: 1 - DNA, 4255 bp, Homo sapiens
agaggtgaaggggcgggcacccggcggccaggagagagagggagggcgccacgcaccggactgcgggccgagagcgcgcacgccgcgctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccaggccttaggaagctcaggaacctactccctgagcatggatgcctgctgctgtcccctgggaacttctggcagaatgactgggaacgcttccatgctgatcctgacatcattgggaccatccaccagcacgagcctaaaaccctgcagacttcagccacactcaaagacttgttatttggtgttcctgggaagtacagcggggtgagcctctacaccaggaagaggatggtctcctacaccatcaccctggtcttccagcactaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccaggcaggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccatatcatcatctgtcaggc

SEQ ID NO: 2 - DNA, 4268 bp, Homo sapiens
ggtgagaggtgaaggggcgggcacccggcggccaggagagagagggagggcgccacgcaccggactgcgggccgagagcgcgcacgccgcgctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccaggccttaggaagctcaggaacctactccctgagcatggatgcctgctgctgtcccctgggaacttctggcagaatgactgggaacgcttccatgctgatcctgacatcattgggaccatccaccagcacgagcctaaaaccctgcagacttcagccacactcaaagacttgttatttggtgttcctgggaagtacagcggggtgagcctctacaccaggaagaggatggtctcctacaccatcaccctggtcttccagcactaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccaggcaggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccatatcatcatctgtcaggcactttggga

SEQ ID NO: 3 - DNA, 4167 bp, Homo sapiens
gagagcgcgcacgccgcgctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccaggccttaggaagctcaggaacctactccctgagcatggatgcctgctgctgtcccctgggaacttctggcagaatgactgggaacgcttccatgctgatcctgacatcattgggaccatccaccagcacgagcctaaaaccctgcagacttcagccacactcaaagacttgttatttggtgttcctgggaagtacagcggggtgagcctctacaccaggaagaggatggtctcctacaccatcaccctggtcttccagcactaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccata

SEQ ID NO: 4 - DNA, 3912 bp, Homo sapiens
acgctccgcccggcccggcccggcccggccgtccatacttccctccggtgtccaccagagggcgaacgggagacgcgaatgtggttcgactacgcatgcgcacgccgctgggcgcacgtgcggagggcggcggggcgggagggtaaaggtaggaggtgagaggtgaaggggcgggcacccggcggccaggagagagagggagggcgccacgcaccggactgcgggccgagagcgcgcacgccgcgctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtgggttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccaggcaggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccata

SEQ ID NO: 5 - DNA, 3909 bp, Homo sapiens
acgctccgcccggcccggcccggcccggccgtccatacttccctccggtgtccaccagagggcgaacgggagacgcgaatgtggttcgactacgcatgcgcacgccgctgggcgcacgtgcggagggcggcggggcgggagggtaaaggtaggaggtgagaggtgaaggggcgggcacccggcggccaggagagagagggagggcgccacgcaccggactgcgggccgagagcgcgcacgccgcgctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtgggttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccata

SEQ ID NO: 6 - DNA, 4270 bp, Homo sapiens
agagtccggtgggaactgggttttaggaggaggtatctgaagaatgtgtagtgggtcgggggctggtgcggtcagaagggccacctctaatttctgccttgcattggtgactagatctgcactttctggaactcccagagaagtttgctggtgcctttgagggcaggtacagggcctgccttatccaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccaggccttaggaagctcaggaacctactccctgagcatggatgcctgctgctgtcccctgggaacttctggcagaatgactgggaacgcttccatgctgatcctgacatcattgggaccatccaccagcacgagcctaaaaccctgcagacttcagccacactcaaagacttgttatttggtgttcctgggaagtacagcggggtgagcctctacaccaggaagaggatggtctcctacaccatcaccctggtcttccagcactaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccaggcaggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccata

SEQ ID NO: 7 - DNA, 2928 bp, Homo sapiens
tggccctggctgccgtggtcacagtgctcagctcgctgctcatgtctgtgggactctgcacactcttcggcctgacgcccaccctcaatggcgggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccaggcaggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccata

SEQ ID NO: 8 - DNA, 3436 bp, Homo sapiens
acccggcggccaggagagagagggagggcgccacgcaccggactgcgggccgagagcgcgcacgccgcgctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccaggcaggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccata

SEQ ID NO: 9 - DNA, 3323 bp, Homo sapiens
acccggcggccaggagagagagggagggcgccacgcaccggactgcgggccgagagcgcgcacgccgcgctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtgggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccaggcaggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccata

SEQ ID NO: 10 - DNA, 3433 bp, Homo sapiens
acccggcggccaggagagagagggagggcgccacgcaccggactgcgggccgagagcgcgcacgccgcgctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccata

SEQ ID NO: 11 - DNA, 4106 bp, Macaca fascicularis
aatgcatggatcagtggagtaaccccagaaaggtacctgcacatgttgttctttgtcagtgccgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcgtatcccatccccatcatcctcttcacggggttctgcatcttagcctgctgctacccactgctgaaactccccttgccaggaacaggacctgtggaattcaccacccctgtaaaggattactcgcccccgcctgtggactctgaccgcaaacaaggagagcctacggagcagcctgagtggtatgtgggtgccccggtggcttacgtccagcagatatttgtgaaatcctcagtgtttccctggcacaagaacctcctggcagtagatgtatttcgttcacctttgtcccgggcattccaactggtggaggagatccggaaccacgtgctgagagacagctctgggaccaggagcttggaggagttgtgtctgcaagtgaccgacctgctgccaggcctcaggaagctcagggacctactccctgagcatggatgcctgctgctgtcccctgggaatttctggcagaatgaccgggaacgcttccatgctgatcctgacatcattgggaccatccaccagcacgagcctaaaaccctgcagacttcagccacactcaaagacttgttgtttggtgttcccgggaagtacagcggggtgagcctctacaccaggaagaggatggtctcctacaccatcaccctggtcttccagcgctaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggccgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtccgtggtctcaaccccggtagacctggaggtgaagctgcggatcgcccaaggcctaagcagcgagagctggtccatcatgaagaacatggccacggagctgggcatcatcctcattggctacttcaccctagtgcctgccatccaggagttctgtctctttgccgtcgtggggctggtgtctgacttcttccttcagatgctgtttttcaccactgtcctgtccattgacattcgccggatggagctagcggacctgaacaagcggctgccccctgaggcctgcctaccctcagccaagccagtggggcagccaacgcgctacgagcggcagctggctgtgcggccgtccacaccccacaccatcacgttgcagccgtcttccttccgaaacctgcggctccccaagaggctgcgtgttgtctacttcctggcccgcacccgcctggcacagcgtctcatcatggctggcaccgttgtctggattggcatcctggtatacacagacccagcagggctgcgcacctacctcgctgcccaggtgacggaacagagcccgctgggtgagggagccctggctcccatgcccgtgcctagtggcatgctgcccgccagccacccggaccctgccttctccatcttcccacctgatgcccctaagctacctgagaaccagacatcgccaggcgagccacctgagcatggaggtccagcagaggttgtccatgacagcccagtcccagaggtaacctgggggcctgaggatgaggaactttggaggaaattgtccttccgccactggccgacgctcttcagctattacaacatcacgctggccaagaggtacatcagcctgctgcctgtcatcccagtcacactccgcctgaacccgagggaggccctggagggccggcaccctcaggatggccgcagtgcctggcccccaccggggcccatacctgctgagcactgggaagcgggacccaagggcccaggtggggtgcaggcccatggagacgtcacactgtacaaggtggcggcactgggtctagccgcgggcattgtgttggtgctgctgctgctctgcctgtaccgtgtgctgtgcccgcgcaactacgggcagccgggcagcgggcccgggcggcggaggcgcggagagctgccctgcgacgactacggctatgcgccacctgagacggagattgtgccgctggtcctgcgcggccacctcatggatatcgagtgcctggccagcgacggcatgctgctggtgagctgttgcctggcaggccacgtctgtgtgtgggacgcacagaccggggattgcctcacgcgtatcccgcgcccagggcagcgccgggacagtggcgtgggcagcgggcttgaggttcaggagagctgggaacgactttcagatggtgggaaggctggcccagaggagcctggggacagccctcccctgagacaccgcccccgggaccctccaccgccttccctcttcggggaccagcctgacctcacctgcttaattgacaccaacttttcggcgcagccacagccctcacagcccactcagcctgagccccggcaccgggcggtctgtggccgcgctcgggactccctaggctatgacttcagccgcctggtgcagcgcgtgtaccaggaggaggggctggcggccgtctgcacaccagccctgcgcccaccctcgcctgggccggtgctgccccaggcccctgaggacgagggtggctcccctgagaaaggctccccttcccttgcctgggcccccagtgcggagggttccatctggagcttggagctgcagggccacctcatcgtggtggggcggagcagcggccggctggaggtgtgggatgccattgaaggggtgctgtgctgcagcagcgaggaggtctcctcaggcattaccgctctggtcttcttggacaaaaggattgtggctgcgcggctcaacggttcccttgatttcttctccttggagacccacactgccctcagccccctgcagtttagagggaccccagggcggggcagttcccctgcctctccagtgtacagcagcagtgacacagtggcctgtcgcctgacccacacagtgccctgtgcacaccaaaaacccatcacagccctgaaagccgctgccgggcgcttggtgactgggagtcaagaccacacgctgagagtattccgtctggaggactcgtgctgcctcttcacccttcagggccactcgggggccatcacgactgtgtacattgaccagaccatggtgctggccagtggaggacaagatggggccatctgcctgtgggatgtactgactggcagccgggtcagccacgtgtttgctcaccgtggggatgtcacctccctcacctgtaccacctcctgtgtcatcagcagtggcctggatgacctcatcagcatctgggaccgcagcacaggcatcaagttctactccattcagcaggatctgggctgtggtgcaagcttgggtgtcatctcagacaacctgctggtgactggcggccaaggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctccgtgctggagaagctggactgagcatggggcctccctgcccaggcaggggtctggggtgctgtgtgggggccaatgcactgaacctggacttgggggaaagagccgagtatcttccagccgctgcctcctgactgtaatattaaacttttttaaaaaacca

SEQ ID NO: 12 - DNA, 4138 bp, Mus musculus
agactacgcatgcgcacgccgccgggagcacgtgtggagggcggcggagcgggaggggaaaggtgcctgcagatgatgtctgctgtaagtgatatccagcatcttccgggctgatccatggtcactttccgggatggcaacaaggtgacttagccgaggatgaccctgactgaaaggcttcgtgagaagatatctcaggccttctacaaccatgggctgctctgcgcatcctatccaattcccatcatcctcttcacaggactctgcatcttagcctgctgctacccgctgctgaagctccccttgcctggaacgggacctgtggaattctccacgcctgtgaagggttactcgcccccgcctgcggactctgaccacaaacaaggagagcccagcgagcagccagagtggtatgtgggtgcccccgtggcgtacatccaacagatatttgtgaagtcatcggtgtctccctggcacagaaatcttctggcagtcgatgtgttccggtcacctctgtcccgagcattccaactggtggaagagatccggaaccatgtgctgagagacagctcagggaccaagagcctggaggaggtttgcctgcaggtgacagacctgctgccaggcctcaggaaactccggagcctacttcccgaacatggctgcctgctgctgtcccctgggaacttctggcagaatgattgggagagattccatgccgaccctgacatcattgggaccatccatcaacatgagcccaaaactctacagacatcagccacactcaaagacttgctgtttggtgttcctgggaagtacagtggggtgagcctctacacaaggaaaaggatggtctcctacaccatcaccctggtcttccagcgctaccatgccaagtttctgagcagcctacgtgcccggctcatgctgctgcaccccagccccaactgcagcctccgagcagagaacctggtccacgtccacttcaaagaggagattggcattgctgagctcatcccgctcgtgaccacctacatcatcctgtttgcctacatctacttctccacacgcaagatcgacatggtcaagtccaagtggggcctcgccctggcagccgtggtcacagtacttagctcactgctcatgtctgtggggctctgcaccctcttcggcctgacgcccacactcaatggcggtgagatcttcccatacctggtggtcgttattgggctagagaacgtgttggtgctcaccaagtcagtggtatcaactccagtggacctcgaggtgaagcttcggattgcacaaggcttgagtagtgagagctggtccatcatgaagaacgcggcgaccgagctgggcatcatcctcattggctacttcaccctcgtgcctgctatccaggagttctgcctctttgctgttgtgggcctggtgtctgacttcttcctccagatgctgttcttcaccactgtcctgtcgatcgacattcgccggatggagctagcagacctaaacaagcggctgccccctgaatcctgcctgccctcagccaagcccgtggggaggccagcacgatatgagagacagcaggctgtacggccatccacgccacacaccatcacattgcaaccatcttccttccgaaacctgcggcttcccaaaaggctgcgtgtcatctacttcctggcccgcactcgcctggcccagcgcctcatcatggctggtaccgttgtctggattggcatcctggtatacaccgacccggcagggctgcgcacctaccttgctgcccaggtgacagagcagagcccactgggtgagggttccctgggccccatgcctgtgcctagcggagtgctgcctgccagccacccggaccctgcattctccatcttcccacctgatgctcctaaactgccagagaaccagaccttgccaggtgagctgcctgagcatgctggtccagcagagggtgtccatgacagccgagccccagaggtaacttgggggcctgaggatgaggagctgtggaggaaattgtccttccgccactggcccacactcttcaactactacaacatcacactggccaaaaggtacatcagcctgctgcctgtcatccctgtcacactacacctgaatccacgggaggctctggaggggcgacaccctcaggatggtcgcagtgcctgggccccacaagagcctttgcccgctggcctctgggagtccggacctaagggaccaggtggaacacagacccatggcgacattaccttgtacaaggtggccgcgcttggcctagcagcgggcatcgtcctggtgctgctgctgctctgcctctaccgggtgctctgcccgcgtaattatgggcagccgggtggtggccccggcaggcggaggcgcggggagctgccctgcgatgactacggctacgcaccgcccgagacggagatagtgccgctggtgctgcgaggtcacctcatggacatcgagtgtctggctagcgatgggatgctactagtgagctgctgcctggcaggccaagtctgcgtgtgggacgctcagacaggggactgcctcacacggatcccacgcccagggccacgccgggatagctgcggaggtggagcttttgagactcaggagaactgggaaaggctgtcagatggaggcaaggctagcccggaagaacctggagacagccctccgctgcgacgacgcccccgagggcctccaccgccttccctctttggggaccagcccgacctcacctgcttaatcgacaccaacttctcggtgcagctgcccccagagcccactcagcccgagcctcggcaccgggtgggctgtggccgctctagagactcgggttatgacttcagccgcctggtgcagcgtgtgtaccaggaggaaggcctggctgctatgcgcatgccggccctgcgcccaccctcccctggacctcccttgccccaggcctctcaagaagaggggactgcacctgagaagggctcccctcccctggcctggacccccagcacagccggttccatctggagcttagagctgcaaggcaatctcatcgtggttgggcggagcagcggccggctggaggtgtgggacgccattgagggggtgctctgctgcagcaatgaggagatctcctcaggcatcacagcccttgtcttcttggacaggaggattgtagctgctcggcttaatggttcccttgatttcttttctttggagacccacacttccctcagccccctgcagttcagagggaccccagggcgaggcagttctccttcctcatctgtgtacagcagcagcaacacagtgacctgtcatcggacccacacagtgccctgtgcacaccagaagcccatcacagccctgagagctgctgccgggcgcctagtgacagggagccaagaccatactctaagagtcttccgactggatgactcgtgttgcctctttaccctgaagggccactcaggggcaatcacagctgtgtacattgatcagaccatggtactggccagtggaggacaagatggagccatctgcctgtgggatgtactaacaggcagccgggtcagccaaacatttgctcaccgtggagatgttacctccctcacctgtaccgcttcctgtgtcattagtagtggcctggatgacttcatcagtatctgggaccgcagcacaggcatcaagctgtactccattcagcaggacctgggctgtggtgcaagcttgggtgtcatctcagataaccttctggtgaccggcggccagggctgtgtctccttttgggacctaaactatggggacctgttacagacagtctacttgggcaagaacagtgaagcccagcctgcccggcagattttggtgttggacaatgctgccattgtctgcaactttggcagtgagctcagcctagtgtatgtgccctctgtgctggagaaactggactgaaggcaggtcaagtacgctattccctttcccccatcccaaggtggggcacaggggatagcaactctttggacctagactagaggcaatagctgactctgaactgttgtctcctgactgtaataataaacttttttaaaaaaccacattt

SEQ ID NO: 13 - DNA, 4301 bp, Rattus norvegicus
ggcggggagctgcgcgggcgccgggcggccgggagggagagggcgggctcgaaacaccggatcgcgggccaggagcgcgcaggccgctctccgccgctccgtcgccgccgcccgggagctgcctcgccgccacaggcacctctcccgtggttggaggaaacgaggcattctagaaggggatagcaggtacctgcagatgatgtgcattgtcattggtatccagcatcttccaggctgatccatggtcactttccgggatggcaacaaggtgacttagctgaggatgaccctgactgaaaggcttcgtgagaagatatctcaggcgttctacaaccatgggctgctctgcgcatcctaccccattcccatcatcctcttcacaggactctgcatcctagcctgctgctacccgctgctgaagcttcccttgcctggaacgggacccgtggaattctccacgcctgtgaagggttactcgcccccgcctgcggactctgaccacaaacaaggagagcccagtgagcagccagagtggtatgtgggtgcccccgtggcatacatccagcagatattcgtgaagtcatcagtgtctccctggcacagaaaccttctggcagtagatgtgttccggtcacctctgtcccgagcattccaactggtggaagagatccggaaccatgtgctgagagacagctcagggaccaagagcctggaggaagtttgcctgcaggtgacagacctgctgccaggcctcaggaaactccggagcctacttcccgaacatggctgcctgctgctgtcacctgggaacttctggcagaatgactgggaaagattccatgctgaccctgacatcattggaaccatccatcagcatgagcctaaaaccctacagacatcagccacactcaaagacttgctgttcggtgttcctgggaagtacagtggggtcagcctctacacgaggaagaggatggtctcatacaccatcaccctggtcttccagcgctaccatgccaagtttctgagcagcctccgtgcccggctcatgcttctgcaccccagccccaactgcagcctccgagcagagaacctggtgcatgtgcacttcaaagaggagattggcattgccgagctcatccccctcgtgaccacctacatcatcctgtttgcctacatctacttctccacacgcaagatcgacatggtcaagtccaagtggggcctcgccctggcagccgtggtcacagtgcttagctcgctgctcatgtctgtggggctctgcactctcttcggcctgacgcccacactcaatggcggcgagattttcccatatctggtggtggttattgggctagagaatgtgttggtgctcaccaagtcagtggtatcaactccagtggaccttgaggtgaagcttcgaattgcacaaggcttaagcagtgagagctggtccatcatgaagaacgtagcaactgaactgggcatcatcctcattggctacttcacccttgtgcctgccatccaagagttctgcctctttgctgtggtgggcctggtgtctgacttcttcctccagatgctgttcttcaccaccgtgctgtccatcgacattcgccggatggagctagcagacctgaacaagcggctgccccctgagtcctgcctgccctcagccaagcctgtggggaggccagcccgatatgagagacagctagctgtacggccgtccacaccacacaccatcacattgcaaccatcttccttccgaaacctgcggcttcccaaaaggctgcgtgtcatctacttcctggcccgcactcgcctggcacagcgcctcatcatggctggtacagttgtctggattggcatcctggtatatacagacccggcagggctgcgcacctacctcgctgcccaggtgacagaacagagcccactgggtgagggttccctggggcccatgcctgtgcctagtggagtgctgcctgccagccacccggaccctgccttctccatcttcccacctgatgctcctaaactgccagagaaccagacgttgccaggtgagctgcctgagcatgccgttccagcagagggcgtccaggacagccgagccccagaggtgacttgggggcccgaggatgaggagctgtggaggaaattgtccttccgccactggcccacactcttcaactactataatatcacactggccaaaaggtacatcagcctgctgcctgtcatccctgtcacactacacctgaatccacgggaggctctggaggggcgacaccctcaggatggccgcactgcctgggccccaccagagcctttgcctgctggcctgtgggagaccggacctaaggggccaggtggaacacagacccatggcgacattaccttgtacaaggtggctgcacttggcctggcagcgggcattgtcctagtgctgctgctgctctgcctctaccgggtgctctgcccgcgaaactacgggcagccgggtggtggtgcgggcaggcggaggcgcggagagctgccttgcgatgactatggctacgcaccgcctgagacggagatagtgccgctggtgctgcgagggcacctcatggacatcgagtgtctggctagcgatgggatgctcctggtgagctgctgcctggctggccaagtctgcgtgtgggatgcacagaccggggactgcctcactcgcatcccgcgccctgggccacgccgggacagctgcggaggcggagcttttgaagctcaggagaactgggaaagactgtctgatgggggcaaagctagcccggaagagcctggcgacagccctccgctgcgacgccgccctcgagggcctccaccgccttccctctttggggaccagccagacctcacctgcttaatcgacaccaacttctcagtgcagctgcccccagagcccactcagcccgagcctcggcaccgggcgggctgtggccgctctagagactctggttacgacttcagccgtctggtgcagcgtgtgtaccaagaggaaggcctggctgctgtgcacatgtcggccctgcgcccaccctccccgggacctcccctgccccaggcctctcaagaagaggggactgctcccgagaagggctccccccctctggcctgggcccccagcacagccggttccatctggagcttagagttgcaaggcagtctcatcgtggttgggcgaagcagcggccggctggaggtgtgggatgccattgagggcgtgctctgctgcagcaatgaggagatctcctcaggcatcacagcccttgtcttcttagacaggaggattgtagctgctcggctcaacggttccctcgatttcttttccttggagacccacacttccctcagccccctgcagttcagagggaccccagggagaggcagttctccttcctcgcctgtgtacagcagcagcaacactgtggcctgtcacctgacccacacagtcccctgtgcacaccagaaacccatcacagccctgagagcagcagcggggcgcctggtgacagggagccaagaccatactctgagagtcttccgactggaggattcgtgttgcctctttaccctgcagggccactcgggggcaatcacaactgtgtacattgatcagaccatggtattggccagtggaggacaagatggagccatctgcctgtgggatgtactaacaggcagccgggtcagccatacatttgctcaccgtggagatgtcacctccctcacctgtaccacttcctgtgttatcagtagtggcctggatgacttcatcaacatctgggaccgaagcacaggcatcaagctgtactccattcagcaggacctgggctgtggtgcaagcttgggtgtcatctctgataaccttctggtgaccggcggccagggatgtgtctccttttgggacctaaactatggggacctgttacagacagtctacttgggaaagaacagtgaagcccagcctgcccggcagattttggtgctggacaatgctgccattgtctgcaactttggcagtgagctcagcctagtgtatgtgccctctgtgctggagaaactggactgaaggcaggtcaactgcactatgcctttcccccatcccaaggtggggcactggggattgcaactctttggacctagactggaggcaataggtaggcatctttgcagctgactcagaactgttgtctcctgactgtaataataaacttttttttaaaaacccaaaaaaaaaagaaaaaaaaaaaaaaaaa

SEQ ID NO: 14 - DNA, 4255 bp, Homo sapiens
gcctgacagatgatgatatggttttttaaaaaagtttaatattattacagtcaggaggcagcggctggaagatactcggctctttcccccaagtccaggttcagtgcattggcccccacacagcaccccagcctcctgcctgggcaaggaggccctgcgctcagtccagcttctccagcacagagggcacatacaccaggctgagctcactgccaaagttgcagacaatggcagcgttgtccagcaccaggatctggcgggcaggctgggcctcactgttcttccccaggtagactgtctgtaacaggtccccgtagtttaggtcccaaaaggagacacagccctggccgccagtcaccagcaggttgtctgagatgacacccaagcttgcaccacagcccaggtcctgctgaatggagtagaacttgatgcctgtgctgcggtcccagatgctgatgaggtcatccaggccactgctgatgacacaggaggtggtacaggtaagggaggtgacatccccacggtgagcaaacacatggctgacccggctgccagtcagtacatcccacaggcagatggccccatcttgtcctccactggccagcaccatggtctggtcaatgtacacggtcgtgatggcccctgagtggccctgaagggtgaagaggcagcacgagtcctccagacggaacactctcagtgtgtggtcttggctcccagtcaccaagcgcccagcagcggctttcagggctgtgatgggtttttggtgtgcacagggcactgtgtgggtcaggtgacaggccactgtgtcgctgctgctgtacactggagaggcaggggaactgccccgccctggggtccctctaaactgcagggggctgagggcagtgtgggtctccaaggagaagaaatcaagggaaccgttgagccgtgcagccacaatccttttgtccaagaacaccagagcggtaatgcctgaggagacctcctcgctgctgcagcacagcaccccttcaatggcgtcccacacctccagccggccgctgctccgccccaccacgatgaggttgccctgcagctccaagctccagatggaaccctcggcactgggggcccaggcgagggaaggggagcctttctcgggggagccaccctcgtcctcaggggcctgggacagcaccggcccaggcgagggtgggcgcagggctggtgtgcagacggccgccagcccctcctcctggtacacccgctgcaccaggcagctgaagtcatagcctggggagtcccgagagcggccacagaccgcccggtgccggggctcgggctgagtgggctgtgaggaccgaggctgcgctgaaaagttggtgtcaattaagcaggtgaggtcaggctggtccccgaagagggaaggcggcggagggccccgggggcggtgtctcaggggagggctgtccccaggctcctctggaccagccttcccaccatctgaaagtcgttcccagctctcctgagcctcaagcccgctgcccacgccactgtcccggcgctgcctgcctgggcgcggaatgcgcgttaggcaatccccggtctgcgcgtcccacacgcagacgtggcctgccaggcagcagctcaccagcagcatgccgtcgctggccaggcactcgatgtccatgaggtggccgcgcagcacaagcggcacgatctccgtctcgggtggcgcatagccgtagtcgtcgcagggcagctccccgcgcctccgccgcccgggcccaccacccagctgcccgtagttgcgcgggcatagcacgcggtagaggcagagcagcagcagcaccaagacgatgccggtggccaggcccagcgccgccaccttgtacagcgtgacgtctccatgggcctgcaccccacctgggcccttgggtcctgcttcccagtgcccagcaggtatgggccccggtgggggccaggcactgcggccgtcctgagggtgccggccctccagagcctccctcgggttcaggcggagcgtgactgggatgacgggcagcaggctgatgtacctcttggccagtgtgatgttgtaatagctgaagagcgtcggccagtggcggaaggacaatttcctccaaagttcctcatcctcaggcccccaggttacctctgggactgggctgtcatggacaacctctgctggacctccacgctcaggtgactcgcctggcgacgtctggttctcaggtagcttaggggcatcaggtgggaagatggagaaggcagggtccgggtggctggggggcagcatgccactaggcacgggcatgggagccagggctccctcacccaatgggctctgttccgtcacctgggcagcgaggtagttgcgcagccctgctgggtctgtgtataccaggatgccaatccagacaacggtgccagccatgatgaggcgctgtgccaggcgggtgcgggccaggaagtagacaacacgcagcctcttggggagccgcaggtttcggaaggaagacggctgcaacgtgatggtgtggggtgtggacggcctcacagccagctgccgctcgtagcgcgttggctgtcccactggcttggctgagggcaggcaggcctcagggggcagtcgcttgttcaggtctgctagctccatccggcgaatgtcaatggacaggacagtggtgaaaaacagcatctgaaggaagaagtcagacaccagccccacgacagcaaagagacagaactcctggatggcgggcactagggtgaagtagccgatgaggatgatgcccagctccgtggccatgttcttcatgatggaccagctctcgctgcttaggccttgggcgatccgcagcttcacctccaggtctaccggggttgagaccacagacttggtgagcaccaacacattctctaacccaataaccaccacaaggtaggggaaaatctcgccgccattgagggtgggcgtcaggccgaagagtgtgcagagtcccacagacatgagcagcgagctgagcactgtgaccacggcagccagggccagcccccacttggacttgaccatgtcgatcttccgcgtggagaagtagatgtaggcaaacaagatgatgtaggtggtcacaagggggatgagctcagcgacaccaatctcctccttgaagtgcacgtggaccaggctctccgcccgaaggctgcagttggggctggggtgcagaagcatcaggcgggcacgcaggctgcccaggaacttggcatggtagtgctggaagaccagggtgatggtgtaggagaccatcctcttcctggtgtagaggctcaccccgctgtacttcccaggaacaccaaataacaagtctttgagtgtggctgaagtctgcagggttttaggctcgtgctggtggatggtcccaatgatgtcaggatcagcatggaagcgttcccagtcattctgccagaagttcccaggggacagcagcaggcatccatgctcagggagtaggttcctgagcttcctaaggcctggcagcaggtcggtcacttgcagacacaactcctccaagctcctgatcccagagctgtctctcagcacgtggttccggatctcctccaccagttggaatgcccgggacaaaggtgaacgaaatacatctactgccaggaggttcttgtgccagggaaacactgaggacttcacaaatatctgctggacataagccaccggggcacccacataccactcaggctgctcagtaggctctccttgtttgcggtcagagtccacaggtgggggcgagtaatccttcacaggggtggtgaattccacaggtcctgttcctggcaaggggagtttcagcagtgggtagcagcaggctaagatgcagaaccctgtgaagaggatgatggggatgggataggatgcacagaggagcccatggttgtagaaggcccgagatatcttctcacgcagcctttcagtcagggtcatcctcagccgaagtcaccttgctgccatcccggaaagtgaccatggatcaccctggcacacacttgacagcactgacaaagaacaacatgtgcaggtacctgtggtggcagcacctcccaagctgcggcggcggcggcggcggcgacgggggcggcagcaggggcggagcgcggcgtgcgcgctctcggcccgcagtccggtgcgtggcgccctccctctctctcctggccgccgggtgcccgccccttcacctct

SEQ ID NO: 15 - DNA, 4268 bp, Homo sapiens
tcccaaagtgcctgacagatgatgatatggttttttaaaaaagtttaatattattacagtcaggaggcagcggctggaagatactcggctctttcccccaagtccaggttcagtgcattggcccccacacagcaccccagcctcctgcctgggcaaggaggccctgcgctcagtccagcttctccagcacagagggcacatacaccaggctgagctcactgccaaagttgcagacaatggcagcgttgtccagcaccaggatctggcgggcaggctgggcctcactgttcttccccaggtagactgtctgtaacaggtccccgtagtttaggtcccaaaaggagacacagccctggccgccagtcaccagcaggttgtctgagatgacacccaagcttgcaccacagcccaggtcctgctgaatggagtagaacttgatgcctgtgctgcggtcccagatgctgatgaggtcatccaggccactgctgatgacacaggaggtggtacaggtaagggaggtgacatccccacggtgagcaaacacatggctgacccggctgccagtcagtacatcccacaggcagatggccccatcttgtcctccactggccagcaccatggtctggtcaatgtacacggtcgtgatggcccctgagtggccctgaagggtgaagaggcagcacgagtcctccagacggaacactctcagtgtgtggtcttggctcccagtcaccaagcgcccagcagcggctttcagggctgtgatgggtttttggtgtgcacagggcactgtgtgggtcaggtgacaggccactgtgtcgctgctgctgtacactggagaggcaggggaactgccccgccctggggtccctctaaactgcagggggctgagggcagtgtgggtctccaaggagaagaaatcaagggaaccgttgagccgtgcagccacaatccttttgtccaagaacaccagagcggtaatgcctgaggagacctcctcgctgctgcagcacagcaccccttcaatggcgtcccacacctccagccggccgctgctccgccccaccacgatgaggttgccctgcagctccaagctccagatggaaccctcggcactgggggcccaggcgagggaaggggagcctttctcgggggagccaccctcgtcctcaggggcctgggacagcaccggcccaggcgagggtgggcgcagggctggtgtgcagacggccgccagcccctcctcctggtacacccgctgcaccaggcagctgaagtcatagcctggggagtcccgagagcggccacagaccgcccggtgccggggctcgggctgagtgggctgtgaggaccgaggctgcgctgaaaagttggtgtcaattaagcaggtgaggtcaggctggtccccgaagagggaaggcggcggagggccccgggggcggtgtctcaggggagggctgtccccaggctcctctggaccagccttcccaccatctgaaagtcgttcccagctctcctgagcctcaagcccgctgcccacgccactgtcccggcgctgcctgcctgggcgcggaatgcgcgttaggcaatccccggtctgcgcgtcccacacgcagacgtggcctgccaggcagcagctcaccagcagcatgccgtcgctggccaggcactcgatgtccatgaggtggccgcgcagcacaagcggcacgatctccgtctcgggtggcgcatagccgtagtcgtcgcagggcagctccccgcgcctccgccgcccgggcccaccacccagctgcccgtagttgcgcgggcatagcacgcggtagaggcagagcagcagcagcaccaagacgatgccggtggccaggcccagcgccgccaccttgtacagcgtgacgtctccatgggcctgcaccccacctgggcccttgggtcctgcttcccagtgcccagcaggtatgggccccggtgggggccaggcactgcggccgtcctgagggtgccggccctccagagcctccctcgggttcaggcggagcgtgactgggatgacgggcagcaggctgatgtacctcttggccagtgtgatgttgtaatagctgaagagcgtcggccagtggcggaaggacaatttcctccaaagttcctcatcctcaggcccccaggttacctctgggactgggctgtcatggacaacctctgctggacctccacgctcaggtgactcgcctggcgacgtctggttctcaggtagcttaggggcatcaggtgggaagatggagaaggcagggtccgggtggctggggggcagcatgccactaggcacgggcatgggagccagggctccctcacccaatgggctctgttccgtcacctgggcagcgaggtagttgcgcagccctgctgggtctgtgtataccaggatgccaatccagacaacggtgccagccatgatgaggcgctgtgccaggcgggtgcgggccaggaagtagacaacacgcagcctcttggggagccgcaggtttcggaaggaagacggctgcaacgtgatggtgtggggtgtggacggcctcacagccagctgccgctcgtagcgcgttggctgtcccactggcttggctgagggcaggcaggcctcagggggcagtcgcttgttcaggtctgctagctccatccggcgaatgtcaatggacaggacagtggtgaaaaacagcatctgaaggaagaagtcagacaccagccccacgacagcaaagagacagaactcctggatggcgggcactagggtgaagtagccgatgaggatgatgcccagctccgtggccatgttcttcatgatggaccagctctcgctgcttaggccttgggcgatccgcagcttcacctccaggtctaccggggttgagaccacagacttggtgagcaccaacacattctctaacccaataaccaccacaaggtaggggaaaatctcgccgccattgagggtgggcgtcaggccgaagagtgtgcagagtcccacagacatgagcagcgagctgagcactgtgaccacggcagccagggccagcccccacttggacttgaccatgtcgatcttccgcgtggagaagtagatgtaggcaaacaagatgatgtaggtggtcacaagggggatgagctcagcgacaccaatctcctccttgaagtgcacgtggaccaggctctccgcccgaaggctgcagttggggctggggtgcagaagcatcaggcgggcacgcaggctgcccaggaacttggcatggtagtgctggaagaccagggtgatggtgtaggagaccatcctcttcctggtgtagaggctcaccccgctgtacttcccaggaacaccaaataacaagtctttgagtgtggctgaagtctgcagggttttaggctcgtgctggtggatggtcccaatgatgtcaggatcagcatggaagcgttcccagtcattctgccagaagttcccaggggacagcagcaggcatccatgctcagggagtaggttcctgagcttcctaaggcctggcagcaggtcggtcacttgcagacacaactcctccaagctcctgatcccagagctgtctctcagcacgtggttccggatctcctccaccagttggaatgcccgggacaaaggtgaacgaaatacatctactgccaggaggttcttgtgccagggaaacactgaggacttcacaaatatctgctggacataagccaccggggcacccacataccactcaggctgctcagtaggctctccttgtttgcggtcagagtccacaggtgggggcgagtaatccttcacaggggtggtgaattccacaggtcctgttcctggcaaggggagtttcagcagtgggtagcagcaggctaagatgcagaaccctgtgaagaggatgatggggatgggataggatgcacagaggagcccatggttgtagaaggcccgagatatcttctcacgcagcctttcagtcagggtcatcctcagccgaagtcaccttgctgccatcccggaaagtgaccatggatcaccctggcacacacttgacagcactgacaaagaacaacatgtgcaggtacctgtggtggcagcacctcccaagctgcggcggcggcggcggcggcgacgggggcggcagcaggggcggagcgcggcgtgcgcgctctcggcccgcagtccggtgcgtggcgccctccctctctctcctggccgccgggtgcccgccccttcacctctcacc

SEQ ID NO: 16 - DNA, 4167 bp, Homo sapiens
tatggttttttaaaaaagtttaatattattacagtcaggaggcagcggctggaagatactcggctctttcccccaagtccaggttcagtgcattggcccccacacagcaccccagcctcctgcctgggcaaggaggccctgcgctcagtccagcttctccagcacagagggcacatacaccaggctgagctcactgccaaagttgcagacaatggcagcgttgtccagcaccaggatctggcgggcaggctgggcctcactgttcttccccaggtagactgtctgtaacaggtccccgtagtttaggtcccaaaaggagacacagccctggccgccagtcaccagcaggttgtctgagatgacacccaagcttgcaccacagcccaggtcctgctgaatggagtagaacttgatgcctgtgctgcggtcccagatgctgatgaggtcatccaggccactgctgatgacacaggaggtggtacaggtaagggaggtgacatccccacggtgagcaaacacatggctgacccggctgccagtcagtacatcccacaggcagatggccccatcttgtcctccactggccagcaccatggtctggtcaatgtacacggtcgtgatggcccctgagtggccctgaagggtgaagaggcagcacgagtcctccagacggaacactctcagtgtgtggtcttggctcccagtcaccaagcgcccagcagcggctttcagggctgtgatgggtttttggtgtgcacagggcactgtgtgggtcaggtgacaggccactgtgtcgctgctgctgtacactggagaggcaggggaactgccccgccctggggtccctctaaactgcagggggctgagggcagtgtgggtctccaaggagaagaaatcaagggaaccgttgagccgtgcagccacaatccttttgtccaagaacaccagagcggtaatgcctgaggagacctcctcgctgctgcagcacagcaccccttcaatggcgtcccacacctccagccggccgctgctccgccccaccacgatgaggttgccctgcagctccaagctccagatggaaccctcggcactgggggcccaggcgagggaaggggagcctttctcgggggagccaccctcgtcctcaggggcctgggacagcaccggcccaggcgagggtgggcgcagggctggtgtgcagacggccgccagcccctcctcctggtacacccgctgcaccaggcagctgaagtcatagcctggggagtcccgagagcggccacagaccgcccggtgccggggctcgggctgagtgggctgtgaggaccgaggctgcgctgaaaagttggtgtcaattaagcaggtgaggtcaggctggtccccgaagagggaaggcggcggagggccccgggggcggtgtctcaggggagggctgtccccaggctcctctggaccagccttcccaccatctgaaagtcgttcccagctctcctgagcctcaagcccgctgcccacgccactgtcccggcgctgccctgggcgcggaatgcgcgttaggcaatccccggtctgcgcgtcccacacgcagacgtggcctgccaggcagcagctcaccagcagcatgccgtcgctggccaggcactcgatgtccatgaggtggccgcgcagcacaagcggcacgatctccgtctcgggtggcgcatagccgtagtcgtcgcagggcagctccccgcgcctccgccgcccgggcccaccacccagctgcccgtagttgcgcgggcatagcacgcggtagaggcagagcagcagcagcaccaagacgatgccggtggccaggcccagcgccgccaccttgtacagcgtgacgtctccatgggcctgcaccccacctgggcccttgggtcctgcttcccagtgcccagcaggtatgggccccggtgggggccaggcactgcggccgtcctgagggtgccggccctccagagcctccctcgggttcaggcggagcgtgactgggatgacgggcagcaggctgatgtacctcttggccagtgtgatgttgtaatagctgaagagcgtcggccagtggcggaaggacaatttcctccaaagttcctcatcctcaggcccccaggttacctctgggactgggctgtcatggacaacctctgctggacctccacgctcaggtgactcgcctggcgacgtctggttctcaggtagcttaggggcatcaggtgggaagatggagaaggcagggtccgggtggctggggggcagcatgccactaggcacgggcatgggagccagggctccctcacccaatgggctctgttccgtcacctgggcagcgaggtagttgcgcagccctgctgggtctgtgtataccaggatgccaatccagacaacggtgccagccatgatgaggcgctgtgccaggcgggtgcgggccaggaagtagacaacacgcagcctcttggggagccgcaggtttcggaaggaagacggctgcaacgtgatggtgtggggtgtggacggcctcacagccagctgccgctcgtagcgcgttggctgtcccactggcttggctgagggcaggcaggcctcagggggcagtcgcttgttcaggtctgctagctccatccggcgaatgtcaatggacaggacagtggtgaaaaacagcatctgaaggaagaagtcagacaccagccccacgacagcaaagagacagaactcctggatggcgggcactagggtgaagtagccgatgaggatgatgcccagctccgtggccatgttcttcatgatggaccagctctcgctgcttaggccttgggcgatccgcagcttcacctccaggtctaccggggttgagaccacagacttggtgagcaccaacacattctctaacccaataaccaccacaaggtaggggaaaatctcgccgccattgagggtgggcgtcaggccgaagagtgtgcagagtcccacagacatgagcagcgagctgagcactgtgaccacggcagccagggccagcccccacttggacttgaccatgtcgatcttccgcgtggagaagtagatgtaggcaaacaagatgatgtaggtggtcacaagggggatgagctcagcgacaccaatctcctccttgaagtgcacgtggaccaggctctccgcccgaaggctgcagttggggctggggtgcagaagcatcaggcgggcacgcaggctgcccaggaacttggcatggtagtgctggaagaccagggtgatggtgtaggagaccatcctcttcctggtgtagaggctcaccccgctgtacttcccaggaacaccaaataacaagtctttgagtgtggctgaagtctgcagggttttaggctcgtgctggtggatggtcccaatgatgtcaggatcagcatggaagcgttcccagtcattctgccagaagttcccaggggacagcagcaggcatccatgctcagggagtaggttcctgagcttcctaaggcctggcagcaggtcggtcacttgcagacacaactcctccaagctcctgatcccagagctgtctctcagcacgtggttccggatctcctccaccagttggaatgcccgggacaaaggtgaacgaaatacatctactgccaggaggttcttgtgccagggaaacactgaggacttcacaaatatctgctggacataagccaccggggcacccacataccactcaggctgctcagtaggctctccttgtttgcggtcagagtccacaggtgggggcgagtaatccttcacaggggtggtgaattccacaggtcctgttcctggcaaggggagtttcagcagtgggtagcagcaggctaagatgcagaaccctgtgaagaggatgatggggatgggataggatgcacagaggagcccatggttgtagaaggcccgagatatcttctcacgcagcctttcagtcagggtcatcctcagccgaagtcaccttgctgccatcccggaaagtgaccatggatcaccctggcacacacttgacagcactgacaaagaacaacatgtgcaggtacctgtggtggcagcacctcccaagctgcggcggcggcggcggcggcgacgggggcggcagcaggggcggagcgcggcgtgcgcgctctc

SEQ ID NO: 17 - DNA, 3912 bp, Homo sapiens
tatggttttttaaaaaagtttaatattattacagtcaggaggcagcggctggaagatactcggctctttcccccaagtccaggttcagtgcattggcccccacacagcaccccagcctcctgcctgggcaaggaggccctgcgctcagtccagcttctccagcacagagggcacatacaccaggctgagctcactgccaaagttgcagacaatggcagcgttgtccagcaccaggatctggcgggcaggctgggcctcactgttcttccccaggtagactgtctgtaacaggtccccgtagtttaggtcccaaaaggagacacagccctggccgccagtcaccagcaggttgtctgagatgacacccaagcttgcaccacagcccaggtcctgctgaatggagtagaacttgatgcctgtgctgcggtcccagatgctgatgaggtcatccaggccactgctgatgacacaggaggtggtacaggtaagggaggtgacatccccacggtgagcaaacacatggctgacccggctgccagtcagtacatcccacaggcagatggccccatcttgtcctccactggccagcaccatggtctggtcaatgtacacggtcgtgatggcccctgagtggccctgaagggtgaagaggcagcacgagtcctccagacggaacactctcagtgtgtggtcttggctcccagtcaccaagcgcccagcagcggctttcagggctgtgatgggtttttggtgtgcacagggcactgtgtgggtcaggtgacaggccactgtgtcgctgctgctgtacactggagaggcaggggaactgccccgccctggggtccctctaaactgcagggggctgagggcagtgtgggtctccaaggagaagaaatcaagggaaccgttgagccgtgcagccacaatccttttgtccaagaacaccagagcggtaatgcctgaggagacctcctcgctgctgcagcacagcaccccttcaatggcgtcccacacctccagccggccgctgctccgccccaccacgatgaggttgccctgcagctccaagctccagatggaaccctcggcactgggggcccaggcgagggaaggggagcctttctcgggggagccaccctcgtcctcaggggcctgggacagcaccggcccaggcgagggtgggcgcagggctggtgtgcagacggccgccagcccctcctcctggtacacccgctgcaccaggcagctgaagtcatagcctggggagtcccgagagcggccacagaccgcccggtgccggggctcgggctgagtgggctgtgaggaccgaggctgcgctgaaaagttggtgtcaattaagcaggtgaggtcaggctggtccccgaagagggaaggcggcggagggccccgggggcggtgtctcaggggagggctgtccccaggctcctctggaccagccttcccaccatctgaaagtcgttcccagctctcctgagcctcaagcccgctgcccacgccactgtcccggcgctgcctgcctgggcgcggaatgcgcgttaggcaatccccggtctgcgcgtcccacacgcagacgtggcctgccaggcagcagctcaccagcagcatgccgtcgctggccaggcactcgatgtccatgaggtggccgcgcagcacaagcggcacgatctccgtctcgggtggcgcatagccgtagtcgtcgcagggcagctccccgcgcctccgccgcccgggcccaccacccagctgcccgtagttgcgcgggcatagcacgcggtagaggcagagcagcagcagcaccaagacgatgccggtggccaggcccagcgccgccaccttgtacagcgtgacgtctccatgggcctgcaccccacctgggcccttgggtcctgcttcccagtgcccagcaggtatgggccccggtgggggccaggcactgcggccgtcctgagggtgccggccctccagagcctccctcgggttcaggcggagcgtgactgggatgacgggcagcaggctgatgtacctcttggccagtgtgatgttgtaatagctgaagagcgtcggccagtggcggaaggacaatttcctccaaagttcctcatcctcaggcccccaggttacctctgggactgggctgtcatggacaacctctgctggacctccacgctcaggtgactcgcctggcgacgtctggttctcaggtagcttaggggcatcaggtgggaagatggagaaggcagggtccgggtggctggggggcagcatgccactaggcacgggcatgggagccagggctccctcacccaatgggctctgttccgtcacctgggcagcgaggtagttgcgcagccctgctgggtctgtgtataccaggatgccaatccagacaacggtgccagccatgatgaggcgctgtgccaggcgggtgcgggccaggaagtagacaacacgcagcctcttggggagccgcaggtttcggaaggaagacggctgcaacgtgatggtgtggggtgtggacggcctcacagccagctgccgctcgtagcgcgttggctgtcccactggcttggctgagggcaggcaggcctcagggggcagtcgcttgttcaggtctgctagctccatccggcgaatgtcaatggacaggacagtggtgaaaaacagcatctgaaggaagaagtcagacaccagccccacgacagcaaagagacagaactcctggatggcgggcactagggtgaagtagccgatgaggatgatgcccagctccgtggccatgttcttcatgatggaccagctctcgctgcttaggccttgggcgatccgcagcttcacctccaggtctaccggggttgagaccacagacttggtgagcaccaacacattctctaacccaataaccaccacaaggtaggggaaaatctcgccgccattgagggtgggcgtcaggccgaagagtgtgcagagtcccacagacatgagcagcgagctgagcactgtgaccacggcagccagggccagcccccacttggacttgaccatgtcgatcttccgcgtggagaagtagatgtaggcaaacaagatgatgtaggtggtcacaagggggatgagctcagcgacaccaatctcctccttgaagtgcacgtggaccaggctctccgcccgaaggctgcagttggggctggggtgcagaagcatcaggcgggcacgcaggctgcccaggaacccactcaggctgctcagtaggctctccttgtttgcggtcagagtccacaggtgggggcgagtaatccttcacaggggtggtgaattccacaggtcctgttcctggcaaggggagtttcagcagtgggtagcagcaggctaagatgcagaaccctgtgaagaggatgatggggatgggataggatgcacagaggagcccatggttgtagaaggcccgagatatcttctcacgcagcctttcagtcagggtcatcctcagccgaagtcaccttgctgccatcccggaaagtgaccatggatcaccctggcacacacttgacagcactgacaaagaacaacatgtgcaggtacctgtggtggcagcacctcccaagctgcggcggcggcggcggcggcgacgggggcggcagcaggggcggagcgcggcgtgcgcgctctcggcccgcagtccggtgcgtggcgccctccctctctctcctggccgccgggtgcccgccccttcacctctcacctcctacctttaccctcccgccccgccgccctccgcacgtgcgcccagcggcgtgcgcatgcgtagtcgaaccacattcgcgtctcccgttcgccctctggtggacaccggagggaagtatggacggccgggccgggccgggccgggcggagcgt

SEQ ID NO: 18 - DNA, 3909 bp, Homo sapiens
tatggttttttaaaaaagtttaatattattacagtcaggaggcagcggctggaagatactcggctctttcccccaagtccaggttcagtgcattggcccccacacagcaccccagcctcctgcctgggcaaggaggccctgcgctcagtccagcttctccagcacagagggcacatacaccaggctgagctcactgccaaagttgcagacaatggcagcgttgtccagcaccaggatctggcgggcaggctgggcctcactgttcttccccaggtagactgtctgtaacaggtccccgtagtttaggtcccaaaaggagacacagccctggccgccagtcaccagcaggttgtctgagatgacacccaagcttgcaccacagcccaggtcctgctgaatggagtagaacttgatgcctgtgctgcggtcccagatgctgatgaggtcatccaggccactgctgatgacacaggaggtggtacaggtaagggaggtgacatccccacggtgagcaaacacatggctgacccggctgccagtcagtacatcccacaggcagatggccccatcttgtcctccactggccagcaccatggtctggtcaatgtacacggtcgtgatggcccctgagtggccctgaagggtgaagaggcagcacgagtcctccagacggaacactctcagtgtgtggtcttggctcccagtcaccaagcgcccagcagcggctttcagggctgtgatgggtttttggtgtgcacagggcactgtgtgggtcaggtgacaggccactgtgtcgctgctgctgtacactggagaggcaggggaactgccccgccctggggtccctctaaactgcagggggctgagggcagtgtgggtctccaaggagaagaaatcaagggaaccgttgagccgtgcagccacaatccttttgtccaagaacaccagagcggtaatgcctgaggagacctcctcgctgctgcagcacagcaccccttcaatggcgtcccacacctccagccggccgctgctccgccccaccacgatgaggttgccctgcagctccaagctccagatggaaccctcggcactgggggcccaggcgagggaaggggagcctttctcgggggagccaccctcgtcctcaggggcctgggacagcaccggcccaggcgagggtgggcgcagggctggtgtgcagacggccgccagcccctcctcctggtacacccgctgcaccaggcagctgaagtcatagcctggggagtcccgagagcggccacagaccgcccggtgccggggctcgggctgagtgggctgtgaggaccgaggctgcgctgaaaagttggtgtcaattaagcaggtgaggtcaggctggtccccgaagagggaaggcggcggagggccccgggggcggtgtctcaggggagggctgtccccaggctcctctggaccagccttcccaccatctgaaagtcgttcccagctctcctgagcctcaagcccgctgcccacgccactgtcccggcgctgccctgggcgcggaatgcgcgttaggcaatccccggtctgcgcgtcccacacgcagacgtggcctgccaggcagcagctcaccagcagcatgccgtcgctggccaggcactcgatgtccatgaggtggccgcgcagcacaagcggcacgatctccgtctcgggtggcgcatagccgtagtcgtcgcagggcagctccccgcgcctccgccgcccgggcccaccacccagctgcccgtagttgcgcgggcatagcacgcggtagaggcagagcagcagcagcaccaagacgatgccggtggccaggcccagcgccgccaccttgtacagcgtgacgtctccatgggcctgcaccccacctgggcccttgggtcctgcttcccagtgcccagcaggtatgggccccggtgggggccaggcactgcggccgtcctgagggtgccggccctccagagcctccctcgggttcaggcggagcgtgactgggatgacgggcagcaggctgatgtacctcttggccagtgtgatgttgtaatagctgaagagcgtcggccagtggcggaaggacaatttcctccaaagttcctcatcctcaggcccccaggttacctctgggactgggctgtcatggacaacctctgctggacctccacgctcaggtgactcgcctggcgacgtctggttctcaggtagcttaggggcatcaggtgggaagatggagaaggcagggtccgggtggctggggggcagcatgccactaggcacgggcatgggagccagggctccctcacccaatgggctctgttccgtcacctgggcagcgaggtagttgcgcagccctgctgggtctgtgtataccaggatgccaatccagacaacggtgccagccatgatgaggcgctgtgccaggcgggtgcgggccaggaagtagacaacacgcagcctcttggggagccgcaggtttcggaaggaagacggctgcaacgtgatggtgtggggtgtggacggcctcacagccagctgccgctcgtagcgcgttggctgtcccactggcttggctgagggcaggcaggcctcagggggcagtcgcttgttcaggtctgctagctccatccggcgaatgtcaatggacaggacagtggtgaaaaacagcatctgaaggaagaagtcagacaccagccccacgacagcaaagagacagaactcctggatggcgggcactagggtgaagtagccgatgaggatgatgcccagctccgtggccatgttcttcatgatggaccagctctcgctgcttaggccttgggcgatccgcagcttcacctccaggtctaccggggttgagaccacagacttggtgagcaccaacacattctctaacccaataaccaccacaaggtaggggaaaatctcgccgccattgagggtgggcgtcaggccgaagagtgtgcagagtcccacagacatgagcagcgagctgagcactgtgaccacggcagccagggccagcccccacttggacttgaccatgtcgatcttccgcgtggagaagtagatgtaggcaaacaagatgatgtaggtggtcacaagggggatgagctcagcgacaccaatctcctccttgaagtgcacgtggaccaggctctccgcccgaaggctgcagttggggctggggtgcagaagcatcaggcgggcacgcaggctgcccaggaacccactcaggctgctcagtaggctctccttgtttgcggtcagagtccacaggtgggggcgagtaatccttcacaggggtggtgaattccacaggtcctgttcctggcaaggggagtttcagcagtgggtagcagcaggctaagatgcagaaccctgtgaagaggatgatggggatgggataggatgcacagaggagcccatggttgtagaaggcccgagatatcttctcacgcagcctttcagtcagggtcatcctcagccgaagtcaccttgctgccatcccggaaagtgaccatggatcaccctggcacacacttgacagcactgacaaagaacaacatgtgcaggtacctgtggtggcagcacctcccaagctgcggcggcggcggcggcggcgacgggggcggcagcaggggcggagcgcggcgtgcgcgctctcggcccgcagtccggtgcgtggcgccctccctctctctcctggccgccgggtgcccgccccttcacctctcacctcctacctttaccctcccgccccgccgccctccgcacgtgcgcccagcggcgtgcgcatgcgtagtcgaaccacattcgcgtctcccgttcgccctctggtggacaccggagggaagtatggacggccgggccgggccgggccgggcggagcgt

SEQ ID NO: 19 - DNA, 4270 bp, Homo sapiens
tatggttttttaaaaaagtttaatattattacagtcaggaggcagcggctggaagatactcggctctttcccccaagtccaggttcagtgcattggcccccacacagcaccccagcctcctgcctgggcaaggaggccctgcgctcagtccagcttctccagcacagagggcacatacaccaggctgagctcactgccaaagttgcagacaatggcagcgttgtccagcaccaggatctggcgggcaggctgggcctcactgttcttccccaggtagactgtctgtaacaggtccccgtagtttaggtcccaaaaggagacacagccctggccgccagtcaccagcaggttgtctgagatgacacccaagcttgcaccacagcccaggtcctgctgaatggagtagaacttgatgcctgtgctgcggtcccagatgctgatgaggtcatccaggccactgctgatgacacaggaggtggtacaggtaagggaggtgacatccccacggtgagcaaacacatggctgacccggctgccagtcagtacatcccacaggcagatggccccatcttgtcctccactggccagcaccatggtctggtcaatgtacacggtcgtgatggcccctgagtggccctgaagggtgaagaggcagcacgagtcctccagacggaacactctcagtgtgtggtcttggctcccagtcaccaagcgcccagcagcggctttcagggctgtgatgggtttttggtgtgcacagggcactgtgtgggtcaggtgacaggccactgtgtcgctgctgctgtacactggagaggcaggggaactgccccgccctggggtccctctaaactgcagggggctgagggcagtgtgggtctccaaggagaagaaatcaagggaaccgttgagccgtgcagccacaatccttttgtccaagaacaccagagcggtaatgcctgaggagacctcctcgctgctgcagcacagcaccccttcaatggcgtcccacacctccagccggccgctgctccgccccaccacgatgaggttgccctgcagctccaagctccagatggaaccctcggcactgggggcccaggcgagggaaggggagcctttctcgggggagccaccctcgtcctcaggggcctgggacagcaccggcccaggcgagggtgggcgcagggctggtgtgcagacggccgccagcccctcctcctggtacacccgctgcaccaggcagctgaagtcatagcctggggagtcccgagagcggccacagaccgcccggtgccggggctcgggctgagtgggctgtgaggaccgaggctgcgctgaaaagttggtgtcaattaagcaggtgaggtcaggctggtccccgaagagggaaggcggcggagggccccgggggcggtgtctcaggggagggctgtccccaggctcctctggaccagccttcccaccatctgaaagtcgttcccagctctcctgagcctcaagcccgctgcccacgccactgtcccggcgctgcctgcctgggcgcggaatgcgcgttaggcaatccccggtctgcgcgtcccacacgcagacgtggcctgccaggcagcagctcaccagcagcatgccgtcgctggccaggcactcgatgtccatgaggtggccgcgcagcacaagcggcacgatctccgtctcgggtggcgcatagccgtagtcgtcgcagggcagctccccgcgcctccgccgcccgggcccaccacccagctgcccgtagttgcgcgggcatagcacgcggtagaggcagagcagcagcagcaccaagacgatgccggtggccaggcccagcgccgccaccttgtacagcgtgacgtctccatgggcctgcaccccacctgggcccttgggtcctgcttcccagtgcccagcaggtatgggccccggtgggggccaggcactgcggccgtcctgagggtgccggccctccagagcctccctcgggttcaggcggagcgtgactgggatgacgggcagcaggctgatgtacctcttggccagtgtgatgttgtaatagctgaagagcgtcggccagtggcggaaggacaatttcctccaaagttcctcatcctcaggcccccaggttacctctgggactgggctgtcatggacaacctctgctggacctccacgctcaggtgactcgcctggcgacgtctggttctcaggtagcttaggggcatcaggtgggaagatggagaaggcagggtccgggtggctggggggcagcatgccactaggcacgggcatgggagccagggctccctcacccaatgggctctgttccgtcacctgggcagcgaggtagttgcgcagccctgctgggtctgtgtataccaggatgccaatccagacaacggtgccagccatgatgaggcgctgtgccaggcgggtgcgggccaggaagtagacaacacgcagcctcttggggagccgcaggtttcggaaggaagacggctgcaacgtgatggtgtggggtgtggacggcctcacagccagctgccgctcgtagcgcgttggctgtcccactggcttggctgagggcaggcaggcctcagggggcagtcgcttgttcaggtctgctagctccatccggcgaatgtcaatggacaggacagtggtgaaaaacagcatctgaaggaagaagtcagacaccagccccacgacagcaaagagacagaactcctggatggcgggcactagggtgaagtagccgatgaggatgatgcccagctccgtggccatgttcttcatgatggaccagctctcgctgcttaggccttgggcgatccgcagcttcacctccaggtctaccggggttgagaccacagacttggtgagcaccaacacattctctaacccaataaccaccacaaggtaggggaaaatctcgccgccattgagggtgggcgtcaggccgaagagtgtgcagagtcccacagacatgagcagcgagctgagcactgtgaccacggcagccagggccagcccccacttggacttgaccatgtcgatcttccgcgtggagaagtagatgtaggcaaacaagatgatgtaggtggtcacaagggggatgagctcagcgacaccaatctcctccttgaagtgcacgtggaccaggctctccgcccgaaggctgcagttggggctggggtgcagaagcatcaggcgggcacgcaggctgcccaggaacttggcatggtagtgctggaagaccagggtgatggtgtaggagaccatcctcttcctggtgtagaggctcaccccgctgtacttcccaggaacaccaaataacaagtctttgagtgtggctgaagtctgcagggttttaggctcgtgctggtggatggtcccaatgatgtcaggatcagcatggaagcgttcccagtcattctgccagaagttcccaggggacagcagcaggcatccatgctcagggagtaggttcctgagcttcctaaggcctggcagcaggtcggtcacttgcagacacaactcctccaagctcctgatcccagagctgtctctcagcacgtggttccggatctcctccaccagttggaatgcccgggacaaaggtgaacgaaatacatctactgccaggaggttcttgtgccagggaaacactgaggacttcacaaatatctgctggacataagccaccggggcacccacataccactcaggctgctcagtaggctctccttgtttgcggtcagagtccacaggtgggggcgagtaatccttcacaggggtggtgaattccacaggtcctgttcctggcaaggggagtttcagcagtgggtagcagcaggctaagatgcagaaccctgtgaagaggatgatggggatgggataggatgcacagaggagcccatggttgtagaaggcccgagatatcttctcacgcagcctttcagtcagggtcatcctcagccgaagtcaccttgctgccatcccggaaagtgaccatggatcaccctggcacacacttgacagcactgacaaagaacaacatgtgcaggtacctggataaggcaggccctgtacctgccctcaaaggcaccagcaaacttctctgggagttccagaaagtgcagatctagtcaccaatgcaaggcagaaattagaggtggcccttctgaccgcaccagcccccgacccactacacattcttcagatacctcctcctaaaacccagttcccaccggactct

SEQ ID NO: 20 - DNA, 2928 bp, Homo sapiens
tatggttttttaaaaaagtttaatattattacagtcaggaggcagcggctggaagatactcggctctttcccccaagtccaggttcagtgcattggcccccacacagcaccccagcctcctgcctgggcaaggaggccctgcgctcagtccagcttctccagcacagagggcacatacaccaggctgagctcactgccaaagttgcagacaatggcagcgttgtccagcaccaggatctggcgggcaggctgggcctcactgttcttccccaggtagactgtctgtaacaggtccccgtagtttaggtcccaaaaggagacacagccctggccgccagtcaccagcaggttgtctgagatgacacccaagcttgcaccacagcccaggtcctgctgaatggagtagaacttgatgcctgtgctgcggtcccagatgctgatgaggtcatccaggccactgctgatgacacaggaggtggtacaggtaagggaggtgacatccccacggtgagcaaacacatggctgacccggctgccagtcagtacatcccacaggcagatggccccatcttgtcctccactggccagcaccatggtctggtcaatgtacacggtcgtgatggcccctgagtggccctgaagggtgaagaggcagcacgagtcctccagacggaacactctcagtgtgtggtcttggctcccagtcaccaagcgcccagcagcggctttcagggctgtgatgggtttttggtgtgcacagggcactgtgtgggtcaggtgacaggccactgtgtcgctgctgctgtacactggagaggcaggggaactgccccgccctggggtccctctaaactgcagggggctgagggcagtgtgggtctccaaggagaagaaatcaagggaaccgttgagccgtgcagccacaatccttttgtccaagaacaccagagcggtaatgcctgaggagacctcctcgctgctgcagcacagcaccccttcaatggcgtcccacacctccagccggccgctgctccgccccaccacgatgaggttgccctgcagctccaagctccagatggaaccctcggcactgggggcccaggcgagggaaggggagcctttctcgggggagccaccctcgtcctcaggggcctgggacagcaccggcccaggcgagggtgggcgcagggctggtgtgcagacggccgccagcccctcctcctggtacacccgctgcaccaggcagctgaagtcatagcctggggagtcccgagagcggccacagaccgcccggtgccggggctcgggctgagtgggctgtgaggaccgaggctgcgctgaaaagttggtgtcaattaagcaggtgaggtcaggctggtccccgaagagggaaggcggcggagggccccgggggcggtgtctcaggggagggctgtccccaggctcctctggaccagccttcccaccatctgaaagtcgttcccagctctcctgagcctcaagcccgctgcccacgccactgtcccggcgctgcctgcctgggcgcggaatgcgcgttaggcaatccccggtctgcgcgtcccacacgcagacgtggcctgccaggcagcagctcaccagcagcatgccgtcgctggccaggcactcgatgtccatgaggtggccgcgcagcacaagcggcacgatctccgtctcgggtggcgcatagccgtagtcgtcgcagggcagctccccgcgcctccgccgcccgggcccaccacccagctgcccgtagttgcgcgggcatagcacgcggtagaggcagagcagcagcagcaccaagacgatgccggtggccaggcccagcgccgccaccttgtacagcgtgacgtctccatgggcctgcaccccacctgggcccttgggtcctgcttcccagtgcccagcaggtatgggccccggtgggggccaggcactgcggccgtcctgagggtgccggccctccagagcctccctcgggttcaggcggagcgtgactgggatgacgggcagcaggctgatgtacctcttggccagtgtgatgttgtaatagctgaagagcgtcggccagtggcggaaggacaatttcctccaaagttcctcatcctcaggcccccaggttacctctgggactgggctgtcatggacaacctctgctggacctccacgctcaggtgactcgcctggcgacgtctggttctcaggtagcttaggggcatcaggtgggaagatggagaaggcagggtccgggtggctggggggcagcatgccactaggcacgggcatgggagccagggctccctcacccaatgggctctgttccgtcacctgggcagcgaggtagttgcgcagccctgctgggtctgtgtataccaggatgccaatccagacaacggtgccagccatgatgaggcgctgtgccaggcgggtgcgggccaggaagtagacaacacgcagcctcttggggagccgcaggtttcggaaggaagacggctgcaacgtgatggtgtggggtgtggacggcctcacagccagctgccgctcgtagcgcgttggctgtcccactggcttggctgagggcaggcaggcctcagggggcagtcgcttgttcaggtctgctagctccatccggcgaatgtcaatggacaggacagtggtgaaaaacagcatctgaaggaagaagtcagacaccagccccacgacagcaaagagacagaactcctggatggcgggcactagggtgaagtagccgatgaggatgatgcccagctccgtggccatgttcttcatgatggaccagctctcgctgcttaggcccgccattgagggtgggcgtcaggccgaagagtgtgcagagtcccacagacatgagcagcgagctgagcactgtgaccacggcagccagggcca

SEQ ID NO: 21 - DNA, 3436 bp, Homo sapiens
tatggttttttaaaaaagtttaatattattacagtcaggaggcagcggctggaagatactcggctctttcccccaagtccaggttcagtgcattggcccccacacagcaccccagcctcctgcctgggcaaggaggccctgcgctcagtccagcttctccagcacagagggcacatacaccaggctgagctcactgccaaagttgcagacaatggcagcgttgtccagcaccaggatctggcgggcaggctgggcctcactgttcttccccaggtagactgtctgtaacaggtccccgtagtttaggtcccaaaaggagacacagccctggccgccagtcaccagcaggttgtctgagatgacacccaagcttgcaccacagcccaggtcctgctgaatggagtagaacttgatgcctgtgctgcggtcccagatgctgatgaggtcatccaggccactgctgatgacacaggaggtggtacaggtaagggaggtgacatccccacggtgagcaaacacatggctgacccggctgccagtcagtacatcccacaggcagatggccccatcttgtcctccactggccagcaccatggtctggtcaatgtacacggtcgtgatggcccctgagtggccctgaagggtgaagaggcagcacgagtcctccagacggaacactctcagtgtgtggtcttggctcccagtcaccaagcgcccagcagcggctttcagggctgtgatgggtttttggtgtgcacagggcactgtgtgggtcaggtgacaggccactgtgtcgctgctgctgtacactggagaggcaggggaactgccccgccctggggtccctctaaactgcagggggctgagggcagtgtgggtctccaaggagaagaaatcaagggaaccgttgagccgtgcagccacaatccttttgtccaagaacaccagagcggtaatgcctgaggagacctcctcgctgctgcagcacagcaccccttcaatggcgtcccacacctccagccggccgctgctccgccccaccacgatgaggttgccctgcagctccaagctccagatggaaccctcggcactgggggcccaggcgagggaaggggagcctttctcgggggagccaccctcgtcctcaggggcctgggacagcaccggcccaggcgagggtgggcgcagggctggtgtgcagacggccgccagcccctcctcctggtacacccgctgcaccaggcagctgaagtcatagcctggggagtcccgagagcggccacagaccgcccggtgccggggctcgggctgagtgggctgtgaggaccgaggctgcgctgaaaagttggtgtcaattaagcaggtgaggtcaggctggtccccgaagagggaaggcggcggagggccccgggggcggtgtctcaggggagggctgtccccaggctcctctggaccagccttcccaccatctgaaagtcgttcccagctctcctgagcctcaagcccgctgcccacgccactgtcccggcgctgcctgcctgggcgcggaatgcgcgttaggcaatccccggtctgcgcgtcccacacgcagacgtggcctgccaggcagcagctcaccagcagcatgccgtcgctggccaggcactcgatgtccatgaggtggccgcgcagcacaagcggcacgatctccgtctcgggtggcgcatagccgtagtcgtcgcagggcagctccccgcgcctccgccgcccgggcccaccacccagctgcccgtagttgcgcgggcatagcacgcggtagaggcagagcagcagcagcaccaagacgatgccggtggccaggcccagcgccgccaccttgtacagcgtgacgtctccatgggcctgcaccccacctgggcccttgggtcctgcttcccagtgcccagcaggtatgggccccggtgggggccaggcactgcggccgtcctgagggtgccggccctccagagcctccctcgggttcaggcggagcgtgactgggatgacgggcagcaggctgatgtacctcttggccagtgtgatgttgtaatagctgaagagcgtcggccagtggcggaaggacaatttcctccaaagttcctcatcctcaggcccccaggttacctctgggactgggctgtcatggacaacctctgctggacctccacgctcaggtgactcgcctggcgacgtctggttctcaggtagcttaggggcatcaggtgggaagatggagaaggcagggtccgggtggctggggggcagcatgccactaggcacgggcatgggagccagggctccctcacccaatgggctctgttccgtcacctgggcagcgaggtagttgcgcagccctgctgggtctgtgtataccaggatgccaatccagacaacggtgccagccatgatgaggcgctgtgccaggcgggtgcgggccaggaagtagacaacacgcagcctcttggggagccgcaggtttcggaaggaagacggctgcaacgtgatggtgtggggtgtggacggcctcacagccagctgccgctcgtagcgcgttggctgtcccactggcttggctgagggcaggcaggcctcagggggcagtcgcttgttcaggtctgctagctccatccggcgaatgtcaatggacaggacagtggtgaaaaacagcatctgaaggaagaagtcagacaccagccccacgacagcaaagagacagaactcctggatggcgggcactagggtgaagtagccgatgaggatgatgcccagctccgtggccatgttcttcatgatggaccagctctcgctgcttaggccttgggcgatccgcagcttcacctccaggtctaccggggttgagaccacagacttggtgagcaccaacacattctctaacccaataaccaccacaaggtaggggaaaatctcgccactcaggctgctcagtaggctctccttgtttgcggtcagagtccacaggtgggggcgagtaatccttcacaggggtggtgaattccacaggtcctgttcctggcaaggggagtttcagcagtgggtagcagcaggctaagatgcagaaccctgtgaagaggatgatggggatgggataggatgcacagaggagcccatggttgtagaaggcccgagatatcttctcacgcagcctttcagtcagggtcatcctcagccgaagtcaccttgctgccatcccggaaagtgaccatggatcaccctggcacacacttgacagcactgacaaagaacaacatgtgcaggtacctgtggtggcagcacctcccaagctgcggcggcggcggcggcggcgacgggggcggcagcaggggcggagcgcggcgtgcgcgctctcggcccgcagtccggtgcgtggcgccctccctctctctcctggccgccgggt

SEQ ID NO: 22 - DNA, 3323 bp, Homo sapiens
tatggttttttaaaaaagtttaatattattacagtcaggaggcagcggctggaagatactcggctctttcccccaagtccaggttcagtgcattggcccccacacagcaccccagcctcctgcctgggcaaggaggccctgcgctcagtccagcttctccagcacagagggcacatacaccaggctgagctcactgccaaagttgcagacaatggcagcgttgtccagcaccaggatctggcgggcaggctgggcctcactgttcttccccaggtagactgtctgtaacaggtccccgtagtttaggtcccaaaaggagacacagccctggccgccagtcaccagcaggttgtctgagatgacacccaagcttgcaccacagcccaggtcctgctgaatggagtagaacttgatgcctgtgctgcggtcccagatgctgatgaggtcatccaggccactgctgatgacacaggaggtggtacaggtaagggaggtgacatccccacggtgagcaaacacatggctgacccggctgccagtcagtacatcccacaggcagatggccccatcttgtcctccactggccagcaccatggtctggtcaatgtacacggtcgtgatggcccctgagtggccctgaagggtgaagaggcagcacgagtcctccagacggaacactctcagtgtgtggtcttggctcccagtcaccaagcgcccagcagcggctttcagggctgtgatgggtttttggtgtgcacagggcactgtgtgggtcaggtgacaggccactgtgtcgctgctgctgtacactggagaggcaggggaactgccccgccctggggtccctctaaactgcagggggctgagggcagtgtgggtctccaaggagaagaaatcaagggaaccgttgagccgtgcagccacaatccttttgtccaagaacaccagagcggtaatgcctgaggagacctcctcgctgctgcagcacagcaccccttcaatggcgtcccacacctccagccggccgctgctccgccccaccacgatgaggttgccctgcagctccaagctccagatggaaccctcggcactgggggcccaggcgagggaaggggagcctttctcgggggagccaccctcgtcctcaggggcctgggacagcaccggcccaggcgagggtgggcgcagggctggtgtgcagacggccgccagcccctcctcctggtacacccgctgcaccaggcagctgaagtcatagcctggggagtcccgagagcggccacagaccgcccggtgccggggctcgggctgagtgggctgtgaggaccgaggctgcgctgaaaagttggtgtcaattaagcaggtgaggtcaggctggtccccgaagagggaaggcggcggagggccccgggggcggtgtctcaggggagggctgtccccaggctcctctggaccagccttcccaccatctgaaagtcgttcccagctctcctgagcctcaagcccgctgcccacgccactgtcccggcgctgcctgcctgggcgcggaatgcgcgttaggcaatccccggtctgcgcgtcccacacgcagacgtggcctgccaggcagcagctcaccagcagcatgccgtcgctggccaggcactcgatgtccatgaggtggccgcgcagcacaagcggcacgatctccgtctcgggtggcgcatagccgtagtcgtcgcagggcagctccccgcgcctccgccgcccgggcccaccacccagctgcccgtagttgcgcgggcatagcacgcggtagaggcagagcagcagcagcaccaagacgatgccggtggccaggcccagcgccgccaccttgtacagcgtgacgtctccatgggcctgcaccccacctgggcccttgggtcctgcttcccagtgcccagcaggtatgggccccggtgggggccaggcactgcggccgtcctgagggtgccggccctccagagcctccctcgggttcaggcggagcgtgactgggatgacgggcagcaggctgatgtacctcttggccagtgtgatgttgtaatagctgaagagcgtcggccagtggcggaaggacaatttcctccaaagttcctcatcctcaggcccccaggttacctctgggactgggctgtcatggacaacctctgctggacctccacgctcaggtgactcgcctggcgacgtctggttctcaggtagcttaggggcatcaggtgggaagatggagaaggcagggtccgggtggctggggggcagcatgccactaggcacgggcatgggagccagggctccctcacccaatgggctctgttccgtcacctgggcagcgaggtagttgcgcagccctgctgggtctgtgtataccaggatgccaatccagacaacggtgccagccatgatgaggcgctgtgccaggcgggtgcgggccaggaagtagacaacacgcagcctcttggggagccgcaggtttcggaaggaagacggctgcaacgtgatggtgtggggtgtggacggcctcacagccagctgccgctcgtagcgcgttggctgtcccactggcttggctgagggcaggcaggcctcagggggcagtcgcttgttcaggtctgctagctccatccggcgaatgtcaatggacaggacagtggtgaaaaacagcatctgaaggaagaagtcagacaccagccccacgacagcaaagagacagaactcctggatggcgggcactagggtgaagtagccgatgaggatgatgcccagctccgtggccatgttcttcatgatggaccagctctcgctgcttaggcccactcaggctgctcagtaggctctccttgtttgcggtcagagtccacaggtgggggcgagtaatccttcacaggggtggtgaattccacaggtcctgttcctggcaaggggagtttcagcagtgggtagcagcaggctaagatgcagaaccctgtgaagaggatgatggggatgggataggatgcacagaggagcccatggttgtagaaggcccgagatatcttctcacgcagcctttcagtcagggtcatcctcagccgaagtcaccttgctgccatcccggaaagtgaccatggatcaccctggcacacacttgacagcactgacaaagaacaacatgtgcaggtacctgtggtggcagcacctcccaagctgcggcggcggcggcggcggcgacgggggcggcagcaggggcggagcgcggcgtgcgcgctctcggcccgcagtccggtgcgtggcgccctccctctctctcctggccgccgggt

SEQ ID NO: 23 - DNA, 3433 bp, Homo sapiens; identical to SEQ ID NO: 10

SEQ ID NO: 24 - DNA, 4106 bp, Macaca fascicularis
tggttttttaaaaaagtttaatattacagtcaggaggcagcggctggaagatactcggctctttcccccaagtccaggttcagtgcattggcccccacacagcaccccagacccctgcctgggcagggaggccccatgctcagtccagcttctccagcacggagggcacatacaccaggctgagctcactgccaaagttgcagacaatggcagcgttgtccagcaccaggatctggcgggcaggctgggcctcactgttcttccccaggtagactgtctgtaacaggtccccgtagtttaggtcccaaaaggagacacagccttggccgccagtcaccagcaggttgtctgagatgacacccaagcttgcaccacagcccagatcctgctgaatggagtagaacttgatgcctgtgctgcggtcccagatgctgatgaggtcatccaggccactgctgatgacacaggaggtggtacaggtgagggaggtgacatccccacggtgagcaaacacgtggctgacccggctgccagtcagtacatcccacaggcagatggccccatcttgtcctccactggccagcaccatggtctggtcaatgtacacagtcgtgatggcccccgagtggccctgaagggtgaagaggcagcacgagtcctccagacggaatactctcagcgtgtggtcttgactcccagtcaccaagcgcccggcagcggctttcagggctgtgatgggtttttggtgtgcacagggcactgtgtgggtcaggcgacaggccactgtgtcactgctgctgtacactggagaggcaggggaactgccccgccctggggtccctctaaactgcagggggctgagggcagtgtgggtctccaaggagaagaaatcaagggaaccgttgagccgcgcagccacaatccttttgtccaagaagaccagagcggtaatgcctgaggagacctcctcgctgctgcagcacagcaccccttcaatggcatcccacacctccagccggccgctgctccgccccaccacgatgaggtggccctgcagctccaagctccagatggaaccctccgcactgggggcccaggcaagggaaggggagcctttctcaggggagccaccctcgtcctcaggggcctggggcagcaccggcccaggcgagggtgggcgcagggctggtgtgcagacggccgccagcccctcctcctggtacacgcgctgcaccaggcggctgaagtcatagcctagggagtcccgagcgcggccacagaccgcccggtgccggggctcaggctgagtgggctgtgagggctgtggctgcgccgaaaagttggtgtcaattaagcaggtgaggtcaggctggtccccgaagagggaaggcggtggagggtcccgggggcggtgtctcaggggagggctgtccccaggctcctctgggccagccttcccaccatctgaaagtcgttcccagctctcctgaacctcaagcccgctgcccacgccactgtcccggcgctgccctgggcgcgggatacgcgtgaggcaatccccggtctgtgcgtcccacacacagacgtggcctgccaggcaacagctcaccagcagcatgccgtcgctggccaggcactcgatatccatgaggtggccgcgcaggaccagcggcacaatctccgtctcaggtggcgcatagccgtagtcgtcgcagggcagctctccgcgcctccgccgcccgggcccgctgcccggctgcccgtagttgcgcgggcacagcacacggtacaggcagagcagcagcagcaccaacacaatgcccgcggctagacccagtgccgccaccttgtacagtgtgacgtctccatgggcctgcaccccacctgggcccttgggtcccgcttcccagtgctcagcaggtatgggccccggtgggggccaggcactgcggccatcctgagggtgccggccctccagggcctccctcgggttcaggcggagtgtgactgggatgacaggcagcaggctgatgtacctcttggccagcgtgatgttgtaatagctgaagagcgtcggccagtggcggaaggacaatttcctccaaagttcctcatcctcaggcccccaggttacctctgggactgggctgtcatggacaacctctgctggacctccatgctcaggtggctcgcctggcgatgtctggttctcaggtagcttaggggcatcaggtgggaagatggagaaggcagggtccgggtggctggcgggcagcatgccactaggcacgggcatgggagccagggctccctcacccagcgggctctgttccgtcacctgggcagcgaggtaggtgcgcagccctgctgggtctgtgtataccaggatgccaatccagacaacggtgccagccatgatgagacgctgtgccaggcgggtgcgggccaggaagtagacaacacgcagcctcttggggagccgcaggtttcggaaggaagacggctgcaacgtgatggtgtggggtgtggacggccgcacagccagctgccgctcgtagcgcgttggctgccccactggcttggctgagggtaggcaggcctcagggggcagccgcttgttcaggtccgctagctccatccggcgaatgtcaatggacaggacagtggtgaaaaacagcatctgaaggaagaagtcagacaccagccccacgacggcaaagagacagaactcctggatggcaggcactagggtgaagtagccaatgaggatgatgcccagctccgtggccatgttcttcatgatggaccagctctcgctgcttaggccttgggcgatccgcagcttcacctccaggtctaccggggttgagaccacggacttggtgagcaccaacacattctctaacccaataaccaccacaaggtaggggaaaatctcgccgccattgagggtgggcgtcaggccgaagagtgtgcagagtcccacagacatgagcagcgagctgagcactgtgaccacggcggccagggccagcccccacttggacttgaccatgtcgatcttccgcgtggagaagtagatgtaggcaaacaagatgatgtaggtggtcacaagggggatgagctcagcgacaccaatctcctccttgaagtgcacgtggaccaggctctccgcccgaaggctgcagttggggctggggtgcagaagcatcaggcgggcacgcaggctgcccaggaacttggcatggtagcgctggaagaccagggtgatggtgtaggagaccatcctcttcctggtgtagaggctcaccccgctgtacttcccgggaacaccaaacaacaagtctttgagtgtggctgaagtctgcagggttttaggctcgtgctggtggatggtcccaatgatgtcaggatcagcatggaagcgttcccggtcattctgccagaaattcccaggggacagcagcaggcatccatgctcagggagtaggtccctgagcttcctgaggcctggcagcaggtcggtcacttgcagacacaactcctccaagctcctggtcccagagctgtctctcagcacgtggttccggatctcctccaccagttggaatgcccgggacaaaggtgaacgaaatacatctactgccaggaggttcttgtgccagggaaacactgaggatttcacaaatatctgctggacgtaagccaccggggcacccacataccactcaggctgctccgtaggctctccttgtttgcggtcagagtccacaggcgggggcgagtaatcctttacaggggtggtgaattccacaggtcctgttcctggcaaggggagtttcagcagtgggtagcagcaggctaagatgcagaaccccgtgaagaggatgatggggatgggatacgatgcacagaggagcccatggttgtagaaggcccgagatatcttctcacgcagcctttcagtcagggtcatcctcagccgaagtcaccttgctgccatcccggaaagtgaccatggatcaccctggcacacacttgacggcactgacaaagaacaacatgtgcaggtacctttctggggttactccactgatccatgcatt

SEQ ID NO: 25 - DNA, 4138 bp, Mus musculus
aaatgtggttttttaaaaaagtttattattacagtcaggagacaacagttcagagtcagctattgcctctagtctaggtccaaagagttgctatcccctgtgccccaccttgggatgggggaaagggaatagcgtacttgacctgccttcagtccagtttctccagcacagagggcacatacactaggctgagctcactgccaaagttgcagacaatggcagcattgtccaacaccaaaatctgccgggcaggctgggcttcactgttcttgcccaagtagactgtctgtaacaggtccccatagtttaggtcccaaaaggagacacagccctggccgccggtcaccagaaggttatctgagatgacacccaagcttgcaccacagcccaggtcctgctgaatggagtacagcttgatgcctgtgctgcggtcccagatactgatgaagtcatccaggccactactaatgacacaggaagcggtacaggtgagggaggtaacatctccacggtgagcaaatgtttggctgacccggctgcctgttagtacatcccacaggcagatggctccatcttgtcctccactggccagtaccatggtctgatcaatgtacacagctgtgattgcccctgagtggcccttcagggtaaagaggcaacacgagtcatccagtcggaagactcttagagtatggtcttggctccctgtcactaggcgcccggcagcagctctcagggctgtgatgggcttctggtgtgcacagggcactgtgtgggtccgatgacaggtcactgtgttgctgctgctgtacacagatgaggaaggagaactgcctcgccctggggtccctctgaactgcagggggctgagggaagtgtgggtctccaaagaaaagaaatcaagggaaccattaagccgagcagctacaatcctcctgtccaagaagacaagggctgtgatgcctgaggagatctcctcattgctgcagcagagcaccccctcaatggcgtcccacacctccagccggccgctgctccgcccaaccacgatgagattgccttgcagctctaagctccagatggaaccggctgtgctgggggtccaggccaggggaggggagcccttctcaggtgcagtcccctcttcttgagaggcctggggcaagggaggtccaggggagggtgggcgcagggccggcatgcgcatagcagccaggccttcctcctggtacacacgctgcaccaggcggctgaagtcataacccgagtctctagagcggccacagcccacccggtgccgaggctcgggctgagtgggctctgggggcagctgcaccgagaagttggtgtcgattaagcaggtgaggtcgggctggtccccaaagagggaaggcggtggaggccctcgggggcgtcgtcgcagcggagggctgtctccaggttcttccgggctagccttgcctccatctgacagcctttcccagttctcctgagtctcaaaagctccacctccgcagctatcccggcgtggccctgggcgtgggatccgtgtgaggcagtcccctgtctgagcgtcccacacgcagacttggcctgccaggcagcagctcactagtagcatcccatcgctagccagacactcgatgtccatgaggtgacctcgcagcaccagcggcactatctccgtctcgggcggtgcgtagccgtagtcatcgcagggcagctccccgcgcctccgcctgccggggccaccacccggctgcccataattacgcgggcagagcacccggtagaggcagagcagcagcagcaccaggacgatgcccgctgctaggccaagcgcggccaccttgtacaaggtaatgtcgccatgggtctgtgttccacctggtcccttaggtccggactcccagaggccagcgggcaaaggctcttgtggggcccaggcactgcgaccatcctgagggtgtcgcccctccagagcctcccgtggattcaggtgtagtgtgacagggatgacaggcagcaggctgatgtaccttttggccagtgtgatgttgtagtagttgaagagtgtgggccagtggcggaaggacaatttcctccacagctcctcatcctcaggcccccaagttacctctggggctcggctgtcatggacaccctctgctggaccagcatgctcaggcagctcacctggcaaggtctggttctctggcagtttaggagcatcaggtgggaagatggagaatgcagggtccgggtggctggcaggcagcactccgctaggcacaggcatggggcccagggaaccctcacccagtgggctctgctctgtcacctgggcagcaaggtaggtgcgcagccctgccgggtcggtgtataccaggatgccaatccagacaacggtaccagccatgatgaggcgctgggccaggcgagtgcgggccaggaagtagatgacacgcagccttttgggaagccgcaggtttcggaaggaagatggttgcaatgtgatggtgtgtggcgtggatggccgtacagcctgctgtctctcatatcgtgctggcctccccacgggcttggctgagggcaggcaggattcagggggcagccgcttgtttaggtctgctagctccatccggcgaatgtcgatcgacaggacagtggtgaagaacagcatctggaggaagaagtcagacaccaggcccacaacagcaaagaggcagaactcctggatagcaggcacgagggtgaagtagccaatgaggatgatgcccagctcggtcgccgcgttcttcatgatggaccagctctcactactcaagccttgtgcaatccgaagcttcacctcgaggtccactggagttgataccactgacttggtgagcaccaacacgttctctagcccaataacgaccaccaggtatgggaagatctcaccgccattgagtgtgggcgtcaggccgaagagggtgcagagccccacagacatgagcagtgagctaagtactgtgaccacggctgccagggcgaggccccacttggacttgaccatgtcgatcttgcgtgtggagaagtagatgtaggcaaacaggatgatgtaggtggtcacgagcgggatgagctcagcaatgccaatctcctctttgaagtggacgtggaccaggttctctgctcggaggctgcagttggggctggggtgcagcagcatgagccgggcacgtaggctgctcagaaacttggcatggtagcgctggaagaccagggtgatggtgtaggagaccatccttttccttgtgtagaggctcaccccactgtacttcccaggaacaccaaacagcaagtctttgagtgtggctgatgtctgtagagttttgggctcatgttgatggatggtcccaatgatgtcagggtcggcatggaatctctcccaatcattctgccagaagttcccaggggacagcagcaggcagccatgttcgggaagtaggctccggagtttcctgaggcctggcagcaggtctgtcacctgcaggcaaacctcctccaggctcttggtccctgagctgtctctcagcacatggttccggatctcttccaccagttggaatgctcgggacagaggtgaccggaacacatcgactgccagaagatttctgtgccagggagacaccgatgacttcacaaatatctgttggatgtacgccacgggggcacccacataccactctggctgctcgctgggctctccttgtttgtggtcagagtccgcaggcgggggcgagtaacccttcacaggcgtggagaattccacaggtcccgttccaggcaaggggagcttcagcagcgggtagcagcaggctaagatgcagagtcctgtgaagaggatgatgggaattggataggatgcgcagagcagcccatggttgtagaaggcctgagatatcttctcacgaagcctttcagtcagggtcatcctcggctaagtcaccttgttgccatcccggaaagtgaccatggatcagcccggaagatgctggatatcacttacagcagacatcatctgcaggcacctttcccctcccgctccgccgccctccacacgtgctcccggcggcgtgcgcatgcgtagtct

SEQ ID NO: 26 - DNA, 4301 bp, Rattus norvegicus
tttttttttttttttttcttttttttttgggtttttaaaaaaaagtttattattacagtcaggagacaacagttctgagtcagctgcaaagatgcctacctattgcctccagtctaggtccaaagagttgcaatccccagtgccccaccttgggatgggggaaaggcatagtgcagttgacctgccttcagtccagtttctccagcacagagggcacatacactaggctgagctcactgccaaagttgcagacaatggcagcattgtccagcaccaaaatctgccgggcaggctgggcttcactgttctttcccaagtagactgtctgtaacaggtccccatagtttaggtcccaaaaggagacacatccctggccgccggtcaccagaaggttatcagagatgacacccaagcttgcaccacagcccaggtcctgctgaatggagtacagcttgatgcctgtgcttcggtcccagatgttgatgaagtcatccaggccactactgataacacaggaagtggtacaggtgagggaggtgacatctccacggtgagcaaatgtatggctgacccggctgcctgttagtacatcccacaggcagatggctccatcttgtcctccactggccaataccatggtctgatcaatgtacacagttgtgattgcccccgagtggccctgcagggtaaagaggcaacacgaatcctccagtcggaagactctcagagtatggtcttggctccctgtcaccaggcgccccgctgctgctctcagggctgtgatgggtttctggtgtgcacaggggactgtgtgggtcaggtgacaggccacagtgttgctgctgctgtacacaggcgaggaaggagaactgcctctccctggggtccctctgaactgcagggggctgagggaagtgtgggtctccaaggaaaagaaatcgagggaaccgttgagccgagcagctacaatcctcctgtctaagaagacaagggctgtgatgcctgaggagatctcctcattgctgcagcagagcacgccctcaatggcatcccacacctccagccggccgctgcttcgcccaaccacgatgagactgccttgcaactctaagctccagatggaaccggctgtgctgggggcccaggccagagggggggagcccttctcgggagcagtcccctcttcttgagaggcctggggcaggggaggtcccggggagggtgggcgcagggccgacatgtgcacagcagccaggccttcctcttggtacacacgctgcaccagacggctgaagtcgtaaccagagtctctagagcggccacagcccgcccggtgccgaggctcgggctgagtgggctctgggggcagctgcactgagaagttggtgtcgattaagcaggtgaggtctggctggtccccaaagagggaaggcggtggaggccctcgagggcggcgtcgcagcggagggctgtcgccaggctcttccgggctagctttgcccccatcagacagtctttcccagttctcctgagcttcaaaagctccgcctccgcagctgtcccggcgtggcccagggcgcgggatgcgagtgaggcagtccccggtctgtgcatcccacacgcagacttggccagccaggcagcagctcaccaggagcatcccatcgctagccagacactcgatgtccatgaggtgccctcgcagcaccagcggcactatctccgtctcaggcggtgcgtagccatagtcatcgcaaggcagctctccgcgcctccgcctgcccgcaccaccacccggctgcccgtagtttcgcgggcagagcacccggtagaggcagagcagcagcagcactaggacaatgcccgctgccaggccaagtgcagccaccttgtacaaggtaatgtcgccatgggtctgtgttccacctggccccttaggtccggtctcccacaggccagcaggcaaaggctctggtggggcccaggcagtgcggccatcctgagggtgtcgcccctccagagcctcccgtggattcaggtgtagtgtgacagggatgacaggcagcaggctgatgtaccttttggccagtgtgatattatagtagttgaagagtgtgggccagtggcggaaggacaatttcctccacagctcctcatcctcgggcccccaagtcacctctggggctcggctgtcctggacgccctctgctggaacggcatgctcaggcagctcacctggcaacgtctggttctctggcagtttaggagcatcaggtgggaagatggagaaggcagggtccgggtggctggcaggcagcactccactaggcacaggcatgggccccagggaaccctcacccagtgggctctgttctgtcacctgggcagcgaggtaggtgcgcagccctgccgggtctgtatataccaggatgccaatccagacaactgtaccagccatgatgaggcgctgtgccaggcgagtgcgggccaggaagtagatgacacgcagccttttgggaagccgcaggtttcggaaggaagatggttgcaatgtgatggtgtgtggtgtggacggccgtacagctagctgtctctcatatcgggctggcctccccacaggcttggctgagggcaggcaggactcagggggcagccgcttgttcaggtctgctagctccatccggcgaatgtcgatggacagcacggtggtgaagaacagcatctggaggaagaagtcagacaccaggcccaccacagcaaagaggcagaactcttggatggcaggcacaagggtgaagtagccaatgaggatgatgcccagttcagttgctacgttcttcatgatggaccagctctcactgcttaagccttgtgcaattcgaagcttcacctcaaggtccactggagttgataccactgacttggtgagcaccaacacattctctagcccaataaccaccaccagatatgggaaaatctcgccgccattgagtgtgggcgtcaggccgaagagagtgcagagccccacagacatgagcagcgagctaagcactgtgaccacggctgccagggcgaggccccacttggacttgaccatgtcgatcttgcgtgtggagaagtagatgtaggcaaacaggatgatgtaggtggtcacgagggggatgagctcggcaatgccaatctcctctttgaagtgcacatgcaccaggttctctgctcggaggctgcagttggggctggggtgcagaagcatgagccgggcacggaggctgctcagaaacttggcatggtagcgctggaagaccagggtgatggtgtatgagaccatcctcttcctcgtgtagaggctgaccccactgtacttcccaggaacaccgaacagcaagtctttgagtgtggctgatgtctgtagggttttaggctcatgctgatggatggttccaatgatgtcagggtcagcatggaatctttcccagtcattctgccagaagttcccaggtgacagcagcaggcagccatgttcgggaagtaggctccggagtttcctgaggcctggcagcaggtctgtcacctgcaggcaaacttcctccaggctcttggtccctgagctgtctctcagcacatggttccggatctcttccaccagttggaatgctcgggacagaggtgaccggaacacatctactgccagaaggtttctgtgccagggagacactgatgacttcacgaatatctgctggatgtatgccacgggggcacccacataccactctggctgctcactgggctctccttgtttgtggtcagagtccgcaggcgggggcgagtaacccttcacaggcgtggagaattccacgggtcccgttccaggcaagggaagcttcagcagcgggtagcagcaggctaggatgcagagtcctgtgaagaggatgatgggaatggggtaggatgcgcagagcagcccatggttgtagaacgcctgagatatcttctcacgaagcctttcagtcagggtcatcctcagctaagtcaccttgttgccatcccggaaagtgaccatggatcagcctggaagatgctggataccaatgacaatgcacatcatctgcaggtacctgctatccccttctagaatgcctcgtttcctccaaccacgggagaggtgcctgtggcggcgaggcagctcccgggcggcggcgacggagcggcggagagcggcctgcgcgctcctggcccgcgatccggtgtttcgagcccgccctctccctcccggccgcccggcgcccgcgcagctccccgcc

SEQ ID NO: 27 - protein, 16 aa, Unknown
  source: /note="Description of Unknown: RFGF peptide"
AAVALLPAVLLALLAP

SEQ ID NO: 28 - protein, 11 aa, Unknown
  source: /note="Description of Unknown: RFGF analogue peptide"
AALLPVLLAAP

SEQ ID NO: 29 - protein, 13 aa, Human immunodeficiency virus
GRKKRRQRRRPPQ

SEQ ID NO: 30 - protein, 16 aa, Drosophila sp.
RQIKIWFQNRRMKWKK

SEQ ID NO: 31 - RNA, 21 nt, Artificial Sequence
  source: /note="Description of Artificial Sequence: Synthetic oligonucleotide"
uggcaacaaggugacuuagca

SEQ ID NO: 32 - RNA, 23 nt, Artificial Sequence
  source: /note="Description of Artificial Sequence: Synthetic oligonucleotide"
ugcuaagucaccuuguugccauc

SEQ ID NO: 33 - RNA, 23 nt, Artificial Sequence
  source: /note="Description of Artificial Sequence: Synthetic oligonucleotide"
gauggcaacaaggugacuuagcc

SEQ ID NO: 34 - RNA, 21 nt, Artificial Sequence
  source: /note="Description of Artificial Sequence: Synthetic oligonucleotide"
cccugacugaaaggcuucgua

SEQ ID NO: 35 - RNA, 23 nt, Artificial Sequence
  source: /note="Description of Artificial Sequence: Synthetic oligonucleotide"
uacgaagccuuucagucaggguc

SEQ ID NO: 36 - RNA, 23 nt, Artificial Sequence
  source: /note="Description of Artificial Sequence: Synthetic oligonucleotide"
gacccugacugaaaggcuucgug

SEQ ID NO: 37 - RNA, 21 nt, Artificial Sequence
  source: /note="Description of Artificial Sequence: Synthetic oligonucleotide"
ggcuucgugagaagauaucua

SEQ ID NO: 38 - RNA, 23 nt, Artificial Sequence
  source: /note="Description of Artificial Sequence: Synthetic oligonucleotide"
uagauaucuucucacgaagccuu

SEQ ID NO: 39 - RNA, 23 nt, Artificial Sequence
  source: /note="Description of Artificial Sequence: Synthetic oligonucleotide"
aaggcuucgugagaagauaucuc

SEQ ID NO: 40 - RNA, 21 nt, Artificial Sequence
  source: /note="Description of Artificial Sequence: Synthetic oligonucleotide"
uggcagcaaggugacuucgga

SEQ ID NO: 41 - RNA, 23 nt, Artificial Sequence
  source: /note="Description of Artificial Sequence: Synthetic oligonucleotide"
uccgaagucaccuugcugccauc

SEQ ID NO: 42 - RNA, 23 nt, Artificial Sequence
  source: /note="Description of Artificial Sequence: Synthetic oligonucleotide"
gauggcagcaaggugacuucggc

SEQ ID NO: 43 - RNA, 21 nt, Artificial Sequence
  source: /note="Description of Artificial Sequence: Synthetic oligonucleotide"
augacccugacugaaaggcua

SEQ ID NO: 44 - RNA, 23 nt, Artificial Sequence
  source: /note="Description of Artificial Sequence: Synthetic oligonucleotide"
uagccuuucagucagggucaucc

SEQ ID NO: 45 - RNA, 23 nt, Artificial Sequence
  source: /note="Description of Artificial Sequence: Synthetic oligonucleotide"
ggaugacccugacugaaaggcug

SEQ ID NO: 46 - RNA, 21 nt, Artificial Sequence
  source: /note="Description of Artificial Sequence: Synthetic oligonucleotide"
aggaacaggaccuguggaauu

SEQ ID NO: 47 - RNA, 23 nt, Artificial Sequence
  source: /note="Description of Artificial Sequence: Synthetic oligonucleotide"
aauuccacagguccuguuccugg

SEQ ID NO: 48 - RNA, 23 nt, Artificial Sequence
  source: /note="Description of Artificial Sequence: Synthetic oligonucleotide"
ccaggaacaggaccuguggaauu

SEQ ID NO: 49 - RNA, 21 nt, Artificial Sequence
  source: /note="Description of Artificial Sequence: Synthetic oligonucleotide"
guccagcagauauuugugaaa

SEQ ID NO: 50 - RNA, 23 nt, Artificial Sequence
  source: /note="Description of Artificial Sequence: Synthetic oligonucleotide"
uuucacaaauaucugcuggacau

SEQ ID NO: 51 - RNA, 23 nt, Artificial Sequence
  source: /note="Description of Artificial Sequence: Synthetic oligonucleotide"
auguccagcagauauuugugaag

SEQ ID NO: 52 - RNA, 21 nt, Artificial Sequence
  source: /note="Description of Artificial Sequence: Synthetic oligonucleotide"
caguagauguauuucguucaa

SEQ ID NO: 53 - RNA, 23 nt, Artificial Sequence
  source: /note="Description of Artificial Sequence: Synthetic oligonucleotide"
uugaacgaaauacaucuacugcc

SEQ ID NO: 54 - RNA, 23 nt, Artificial Sequence
  source: /note="Description of Artificial Sequence: Synthetic oligonucleotide"
ggcaguagauguauuucguucac

SEQ ID NO: 55 - RNA, 21 nt, Artificial Sequence
  source: /note="Description of Artificial Sequence: Synthetic oligonucleotide"
cacgugcugagagacagcucu

SEQ ID NO: 56 - RNA, 23 nt, Artificial Sequence
  source: /note="Description of Artificial Sequence: Synthetic oligonucleotide"
agagcugucucucagcacguggu

SEQ ID NO: 57 - RNA, 23 nt, Artificial Sequence
  source: /note="Description of Artificial Sequence: Synthetic oligonucleotide"
accacgugcugagagacagcucu

SEQ ID NO: 58 - RNA, 21 nt, Artificial Sequence
  source: /note="Description of Artificial Sequence: Synthetic oligonucleotide"
uuccaugcugauccugacaua

SEQ ID NO: 59 - RNA, 23 nt, Artificial Sequence
  source: /note="Description of Artificial Sequence: Synthetic oligonucleotide"
uaugucaggaucagcauggaagc

SEQ ID NO: 60 - RNA, 23 nt, Artificial Sequence
  source: /note="Description of Artificial Sequence: Synthetic oligonucleotide"
gcuuccaugcugauccugacauc

SEQ ID NO: 61 - RNA, 21 nt, Artificial Sequence
  source: /note="Description of Artificial Sequence: Synthetic oligonucleotide"
caccaggaagaggauggucua

SEQ ID NO: 62 - RNA, 23 nt, Artificial Sequence
  source: /note="Description of Artificial Sequence: Synthetic oligonucleotide"
uagaccauccucuuccuggugua

SEQ ID NO: 63 - RNA, 23 nt, Artificial Sequence
  source: /note="Description of Artificial Sequence: Synthetic oligonucleotide"
uacaccaggaagaggauggucuc

SEQ ID NO: 64 - RNA, 21 nt, Artificial Sequence
  source: /note="Description of Artificial Sequence: Synthetic oligonucleotide"
caggaagaggauggucuccua

SEQ ID NO: 65 - RNA, 23 nt, Artificial Sequence
  source: /note="Description of Artificial Sequence: Synthetic oligonucleotide"
uaggagaccauccucuuccuggu

SEQ ID NO: 66 - RNA, 23 nt, Artificial Sequence
  source: /note="Description of Artificial Sequence: Synthetic oligonucleotide"
accaggaagaggauggucuccua

SEQ ID NO: 67 - RNA, 21 nt, Artificial Sequence
  source: /note="Description of Artificial Sequence: Synthetic oligonucleotide"
aucaucuuguuugccuacaua

SEQ ID NO: 68 - RNA, 23 nt, Artificial Sequence
  source: /note="Description of Artificial Sequence: Synthetic oligonucleotide"
uauguaggcaaacaagaugaugu

SEQ ID NO: 69 - RNA, 23 nt, Artificial Sequence
  source: /note="Description of Artificial Sequence: Synthetic oligonucleotide"
acaucaucuuguuugccuacauc

SEQ ID NO: 70 - RNA, 21 nt, Artificial Sequence
  source: /note="Description of Artificial Sequence: Synthetic oligonucleotide"
caucuuguuugccuacaucua

SEQ ID NO: 71 - RNA, 23 nt, Artificial Sequence
  source: /note="Description of Artificial Sequence: Synthetic oligonucleotide"
uagauguaggcaaacaagaugau

SEQ ID NO: 72 - RNA, 23 nt, Artificial Sequence
  source: /note="Description of Artificial Sequence: Synthetic oligonucleotide"
aucaucuuguuugccuacaucua

SEQ ID NO: 73 - RNA, 21 nt, Artificial Sequence
  source: /note="Description of Artificial Sequence: Synthetic oligonucleotide"
ucuuguuugccuacaucuacu

SEQ ID NO: 74 - RNA, 23 nt, Artificial Sequence
  source: /note="Description of Artificial Sequence: Synthetic oligonucleotide"
aguagauguaggcaaacaagaug

SEQ ID NO: 75 - RNA, 23 nt, Artificial Sequence
  source: /note="Description of Artificial Sequence: Synthetic oligonucleotide"
caucuuguuugccuacaucuacu

SEQ ID NO: 76 - RNA, 21 nt, Artificial Sequence
  source: /note="Description of Artificial Sequence: Synthetic oligonucleotide"
gaagaucgacauggucaagua

SEQ ID NO: 77 - RNA, 23 nt, Artificial Sequence
  source: /note="Description of Artificial Sequence: Synthetic oligonucleotide"
uacuugaccaugucgaucuuccg

SEQ ID NO: 78 - RNA, 23 nt, Artificial Sequence
  source: /note="Description of Artificial Sequence: Synthetic oligonucleotide"
cggaagaucgacauggucaaguc

SEQ ID NO: 79 - RNA, 21 nt, Artificial Sequence
  source: /note="Description of Artificial Sequence: Synthetic oligonucleotide"
gcucaccaagucagugguaua

SEQ ID NO: 80 - RNA, 23 nt, Artificial Sequence
  source: /note="Description of Artificial Sequence: Synthetic oligonucleotide"
uauaccacugacuuggugagcac

SEQ ID NO: 81 - RNA, 23 nt, Artificial Sequence
  source: /note="Description of Artificial Sequence: Synthetic oligonucleotide"
gugcucaccaagucagugguauc

SEQ ID NO: 82 - RNA, 21 nt, Artificial Sequence
  source: /note="Description of Artificial Sequence: Synthetic oligonucleotide"
caccaagucagugguaucaaa

SEQ ID NO: 83 - RNA, 23 nt, Artificial Sequence
  source: /note="Description of Artificial Sequence: Synthetic oligonucleotide"
uuugauaccacugacuuggugag

SEQ ID NO: 84 - RNA, 23 nt, Artificial Sequence
  source: /note="Description of Artificial Sequence: Synthetic oligonucleotide"
cucaccaagucagugguaucaac

SEQ ID NO: 85 - RNA, 21 nt, Artificial Sequence
  source: /note="Description of Artificial Sequence: Synthetic oligonucleotide"
cucaauggcggcgagauuuua

SEQ ID NO: 86 - RNA, 23 nt, Artificial Sequence
  source: /note="Description of Artificial Sequence: Synthetic oligonucleotide"
uaaaaucucgccgccauugaggg

SEQ ID NO: 87 - RNA, 23 nt, Artificial Sequence
  source: /note="Description of Artificial Sequence: Synthetic oligonucleotide"
cccucaauggcggcgagauuuuc

SEQ ID NO: 88 - RNA, 21 nt, Artificial Sequence
  source: /note="Description of Artificial Sequence: Synthetic oligonucleotide"
uaccuuguggugguuauugga

SEQ ID NO: 89 - RNA, 23 nt, Artificial Sequence
  source: /note="Description of Artificial Sequence: Synthetic oligonucleotide"
uccaauaaccaccacaagguagg

SEQ ID NO: 90 - RNA, 23 nt, Artificial Sequence
  source: /note="Description of Artificial Sequence: Synthetic oligonucleotide"
ccuaccuuguggugguuauuggg

SEQ ID NO: 91 - RNA, 21 nt, Artificial Sequence
  source: /note="Description of Artificial Sequence: Synthetic oligonucleotide"
ugguuauuggguuagagaaua

SEQ ID NO: 92 - RNA, 23 nt, Artificial Sequence
  source: /note="Description of Artificial Sequence: Synthetic oligonucleotide"
uauucucuaacccaauaaccacc

SEQ ID NO: 93 - RNA, 23 nt, Artificial Sequence
  source: /note="Description of Artificial Sequence: Synthetic oligonucleotide"
ggugguuauuggguuagagaaug

SEQ ID NO: 94 - RNA, 21 nt, Artificial Sequence
  source: /note="Description of Artificial Sequence: Synthetic oligonucleotide"
guuauuggguuagagaaugua

SEQ ID NO: 95 - RNA, 23 nt, Artificial Sequence
  source: /note="Description of Artificial Sequence: Synthetic oligonucleotide"
uacauucucuaacccaauaacca

SEQ ID NO: 96 - RNA, 23 nt, Artificial Sequence
  source: /note="Description of Artificial Sequence: Synthetic oligonucleotide"
ugguuauuggguuagagaaugug

SEQ ID NO: 97 - RNA, 21 nt, Artificial Sequence
  source: /note="Description of Artificial Sequence: Synthetic oligonucleotide"
guuagagaauguguuggugcu

SEQ ID NO: 98 - RNA, 23 nt, Artificial Sequence
  source: /note="Description of Artificial Sequence: Synthetic oligonucleotide"
agcaccaacacauucucuaaccc

SEQ ID NO: 99 - RNA, 23 nt, Artificial Sequence
  source: /note="Description of Artificial Sequence: Synthetic oligonucleotide"
ggguuagagaauguguuggugcu

SEQ ID NO: 100 - RNA, 21 nt, Artificial Sequence
  source: /note="Description of Artificial Sequence: Synthetic oligonucleotide"
cugacugaaaggcuucgugaa

SEQ ID NO: 101 - RNA, 23 nt, Artificial Sequence
  source: /note="Description of Artificial Sequence: Synthetic oligonucleotide"
uucacgaagccuuucagucaggg

SEQ ID NO: 102 - RNA, 23 nt, Artificial Sequence
  source: /note="Description of Artificial Sequence: Synthetic oligonucleotide"
cccugacugaaaggcuucgugag

SEQ ID NO: 103 - RNA, 21 nt, Artificial Sequence
  source: /note="Description of Artificial Sequence: Synthetic oligonucleotide"
accguugucuggauuggcaua

SEQ ID NO: 104 - RNA, 23 nt, Artificial Sequence
  source: /note="Description of Artificial Sequence: Synthetic oligonucleotide"
uaugccaauccagacaacggugc

SEQ ID NO: 105 - RNA, 23 nt, Artificial Sequence
  source: /note="Description of Artificial Sequence: Synthetic oligonucleotide"
gcaccguugucuggauuggcauc

SEQ ID NO: 106 - RNA, 21 nt, Artificial Sequence
  source: /note="Description of Artificial Sequence: Synthetic oligonucleotide"
acuuuggaggaaauuguccuu

SEQ ID NO: 107 - RNA, 23 nt, Artificial Sequence
  source: /note="Description of Artificial Sequence: Synthetic oligonucleotide"
aaggacaauuuccuccaaaguuc

SEQ ID NO: 108 - RNA, 23 nt, Artificial Sequence
  source: /note="Description of Artificial Sequence: Synthetic oligonucleotide"
gaacuuuggaggaaauuguccuu

SEQ ID NO: 109 - RNA, 21 nt, Artificial Sequence
  source: /note="Description of Artificial Sequence: Synthetic oligonucleotide"
uuuggaggaaauuguccuuca

SEQ ID NO: 110 - RNA, 23 nt, Artificial Sequence
  source: /note="Description of Artificial Sequence: Synthetic oligonucleotide"
ugaaggacaauuuccuccaaagu

SEQ ID NO: 111 - RNA, 23 nt, Artificial Sequence
  source: /note="Description of Artificial Sequence: Synthetic oligonucleotide"
acuuuggaggaaauuguccuucc

SEQ ID NO: 112 - RNA, 21 nt, Artificial Sequence
  source: /note="Description of Artificial Sequence: Synthetic oligonucleotide"
ggagagcugggaacgacuuua

SEQ ID NO: 113 - RNA, 23 nt, Artificial Sequence
  source: /note="Description of Artificial Sequence: Synthetic oligonucleotide"
uaaagucguucccagcucuccug

SEQ ID NO: 114 - RNA, 23 nt, Artificial Sequence
  source: /note="Description of Artificial Sequence: Synthetic oligonucleotide"
caggagagcugggaacgacuuuc

SEQ ID NO: 115 - RNA, 21 nt, Artificial Sequence
  source: /note="Description of Artificial Sequence: Synthetic oligonucleotide"
agcugggaacgacuuucagau

SEQ ID NO: 116 - RNA, 23 nt, Artificial Sequence
  source: /note="Description of Artificial Sequence: Synthetic oligonucleotide"
aucugaaagucguucccagcucu

SEQ ID NO: 117 - RNA, 23 nt, Artificial Sequence
  source: /note="Description of Artificial Sequence: Synthetic oligonucleotide"
agagcugggaacgacuuucagau

SEQ ID NO: 118 - RNA, 21 nt, Artificial Sequence
  source: /note="Description of Artificial Sequence: Synthetic oligonucleotide"
cgacuuucagauggugggaaa

SEQ ID NO: 119 - RNA, 23 nt, Artificial Sequence
  source: /note="Description of Artificial Sequence: Synthetic oligonucleotide"
uuucccaccaucugaaagucguu

SEQ ID NO: 120 - RNA, 23 nt, Artificial Sequence
  source: /note="Description of Artificial Sequence: Synthetic oligonucleotide"
aacgacuuucagauggugggaag

SEQ ID NO: 121 - RNA, 21 nt, Artificial Sequence
  source: /note="Description of Artificial Sequence: Synthetic oligonucleotide"
accugcuuaauugacaccaaa

SEQ ID NO: 122 - RNA, 23 nt, Artificial Sequence
  source: /note="Description of Artificial Sequence: Synthetic oligonucleotide"
uuuggugucaauuaagcagguga

SEQ ID NO: 123 - RNA, 23 nt, Artificial Sequence
  source: /note="Description of Artificial Sequence: Synthetic oligonucleotide"
ucaccugcuuaauugacaccaac

SEQ ID NO: 124 - RNA, 21 nt, Artificial Sequence
  source: /note="Description of Artificial Sequence: Synthetic oligonucleotide"
gcuuaauugacaccaacuuuu

SEQ ID NO: 125 - RNA, 23 nt, Artificial Sequence
  source: /note="Description of Artificial Sequence: Synthetic oligonucleotide"
aaaaguuggugucaauuaagcag

SEQ ID NO: 126 - RNA, 23 nt, Artificial Sequence
  source: /note="Description of Artificial Sequence: Synthetic oligonucleotide"
cugcuuaauugacaccaacuuuu

SEQ ID NO: 127 - RNA, 21 nt, Artificial Sequence
  source: /note="Description of Artificial Sequence: Synthetic oligonucleotide"
gggagccaagaccauacucua

SEQ ID NO: 128 - RNA, 23 nt, Artificial Sequence
  source: /note="Description of Artificial Sequence: Synthetic oligonucleotide"
uagaguauggucuuggcucccug

SEQ ID NO: 129 - RNA, 23 nt, Artificial Sequence
  source: /note="Description of Artificial Sequence: Synthetic oligonucleotide"
cagggagccaagaccauacucua

SEQ ID NO: 130 - RNA, 21 nt, Artificial Sequence
  source: /note="Description of Artificial Sequence: Synthetic oligonucleotide"
acccaucacagcccugaaaga

SEQ ID NO: 131 - RNA, 23 nt, Artificial Sequence
  source: /note="Description of Artificial Sequence: Synthetic oligonucleotide"
ucuuucagggcugugauggguuu

SEQ ID NO: 132 - RNA, 23 nt, Artificial Sequence
  source: /note="Description of Artificial Sequence: Synthetic oligonucleotide"
aaacccaucacagcccugaaagc

SEQ ID NO: 133 - RNA, 21 nt, Artificial Sequence
  source: /note="Description of Artificial Sequence: Synthetic oligonucleotide"
acagcuguguacauugaucaa

SEQ ID NO: 134 - RNA, 23 nt, Artificial Sequence
  source: /note="Description of Artificial Sequence: Synthetic oligonucleotide"
uugaucaauguacacagcuguga

SEQ ID NO: 135 - RNA, 23 nt, Artificial Sequence
  source: /note="Description of Artificial Sequence: Synthetic oligonucleotide"
ucacagcuguguacauugaucag

SEQ ID NO: 136 - RNA, 21 nt, Artificial Sequence
  source: /note="Description of Artificial Sequence: Synthetic oligonucleotide"
agcuguguacauugaucagaa

SEQ ID NO: 137 - RNA, 23 nt, Artificial Sequence
  source: /note="Description of Artificial Sequence: Synthetic oligonucleotide"
uucugaucaauguacacagcugu

SEQ ID NO: 138 - RNA, 23 nt, Artificial Sequence
  source: /note="Description of Artificial Sequence: Synthetic oligonucleotide"
acagcuguguacauugaucagac

SEQ ID NO: 139 - RNA, 21 nt, Artificial Sequence
  source: /note="Description of Artificial Sequence: Synthetic oligonucleotide"
cugccugugggauguacuaaa

SEQ ID NO: 140 - RNA, 23 nt, Artificial Sequence
  source: /note="Description of Artificial Sequence: Synthetic oligonucleotide"
uuuaguacaucccacaggcagau

SEQ ID NO: 141 - RNA, 23 nt, Artificial Sequence
  source: /note="Description of Artificial Sequence: Synthetic oligonucleotide"
aucugccugugggauguacuaac

SEQ ID NO: 142 - RNA, 21 nt, Artificial Sequence
  source: /note="Description of Artificial Sequence: Synthetic oligonucleotide"
aguggccuggaugacuucaua

SEQ ID NO: 143 - RNA, 23 nt, Artificial Sequence
  source: /note="Description of Artificial Sequence: Synthetic oligonucleotide"
uaugaagucauccaggccacuac

SEQ ID NO: 144 - RNA, 23 nt, Artificial Sequence
  source: /note="Description of Artificial Sequence: Synthetic oligonucleotide"
guaguggccuggaugacuucauc

SEQ ID NO: 145 - RNA, 21 nt, Artificial Sequence
  source: /note="Description of Artificial Sequence: Synthetic oligonucleotide"
cuccuuuugggaccuaaacua

SEQ ID NO: 146 - RNA, 23 nt, Artificial Sequence
  source: /note="Description of Artificial Sequence: Synthetic oligonucleotide"
uaguuuaggucccaaaaggagac

SEQ ID NO: 147 - RNA, 23 nt, Artificial Sequence
  source: /note="Description of Artificial Sequence: Synthetic oligonucleotide"
gucuccuuuugggaccuaaacua

SEQ ID NO: 148 - RNA, 21 nt, Artificial Sequence
  source: /note="Description of Artificial Sequence: Synthetic oligonucleotide"
ccuuuugggaccuaaacuaua

SEQ ID NO: 149 - RNA, 23 nt, Artificial Sequence
  source: /note="Description of Artificial Sequence: Synthetic oligonucleotide"
uauaguuuaggucccaaaaggag

SEQ ID NO: 150 - RNA, 23 nt, Artificial Sequence
  source: /note="Description of Artificial Sequence: Synthetic oligonucleotide"
cuccuuuugggaccuaaacuaug

SEQ ID NO: 151 - RNA, 21 nt, Artificial Sequence
  source: /note="Description of Artificial Sequence: Synthetic oligonucleotide"
aagcuugggugucaucucaga

SEQ ID NO: 152 - RNA, 23 nt, Artificial Sequence
  source: /note="Description of Artificial Sequence: Synthetic oligonucleotide"
ucugagaugacacccaagcuugc

SEQ ID NO: 153 - RNA, 23 nt, Artificial Sequence
  source: /note="Description of Artificial Sequence: Synthetic oligonucleotide"
gcaagcuugggugucaucucaga

SEQ ID NO: 154 - RNA, 21 nt, Artificial Sequence
  source: /note="Description of Artificial Sequence: Synthetic oligonucleotide"
agggcugugucuccuuuugga

SEQ ID NO: 155 - RNA, 23 nt, Artificial Sequence
  source: /note="Description of Artificial Sequence: Synthetic oligonucleotide"
uccaaaaggagacacagcccugg

SEQ ID NO: 156 - RNA, 23 nt, Artificial Sequence
  source: /note="Description of Artificial Sequence: Synthetic oligonucleotide"
ccagggcugugucuccuuuuggg

SEQ ID NO: 157 - RNA, 21 nt, Artificial Sequence
  source: /note="Description of Artificial Sequence: Synthetic oligonucleotide"
gcugccauugucugcaacuuu

SEQ ID NO: 158 - RNA, 23 nt, Artificial Sequence
  source: /note="Description of Artificial Sequence: Synthetic oligonucleotide"
aaaguugcagacaauggcagcgu

SEQ ID NO: 159 - RNA, 23 nt, Artificial Sequence
  source: /note="Description of Artificial Sequence: Synthetic oligonucleotide"
acgcugccauugucugcaacuuu

SEQ ID NO: 160 - RNA, 21 nt, Artificial Sequence
  source: /note="Description of Artificial Sequence: Synthetic oligonucleotide"
cugccauugucugcaacuuua

SEQ ID NO: 161 - RNA, 23 nt, Artificial Sequence
  source: /note="Description of Artificial Sequence: Synthetic oligonucleotide"
uaaaguugcagacaauggcagcg

SEQ ID NO: 162 - RNA, 23 nt, Artificial Sequence
  source: /note="Description of Artificial Sequence: Synthetic oligonucleotide"
cgcugccauugucugcaacuuug

SEQ ID NO: 163 - RNA, 21 nt, Artificial Sequence
  source: /note="Description of Artificial Sequence: Synthetic oligonucleotide"
aacuuuggcagugagcucaga

SEQ ID NO: 164 - RNA, 23 nt, Artificial Sequence
  source: /note="Description of Artificial Sequence: Synthetic oligonucleotide"
ucugagcucacugccaaaguugc

SEQ ID NO: 165 - RNA, 23 nt, Artificial Sequence
  source: /note="Description of Artificial Sequence: Synthetic oligonucleotide"
gcaacuuuggcagugagcucagc

SEQ ID NO: 166 - RNA, 21 nt, Artificial Sequence
  source: /note="Description of Artificial Sequence: Synthetic oligonucleotide"
ucuccugacuguaauaauaaa

SEQ ID NO: 167 - RNA, 23 nt, Artificial Sequence
  source: /note="Description of Artificial Sequence: Synthetic oligonucleotide"
uuuauuauuacagucaggagaca

SEQ ID NO: 168 - RNA, 23 nt, Artificial Sequence
  source: /note="Description of Artificial Sequence: Synthetic oligonucleotide"
ugucuccugacuguaauaauaaa

SEQ ID NO: 169 - RNA, 21 nt, Artificial Sequence
  source: /note="Description of Artificial Sequence: Synthetic oligonucleotide"
uggcaacaaggugacuuagca

SEQ ID NO: 170 - RNA, 23 nt, Artificial Sequence
  source: /note="Description of Artificial Sequence: Synthetic oligonucleotide"
ugcuaagucaccuuguugccauc

SEQ ID NO: 171 - RNA, 21 nt, Artificial Sequence
  source: /note="Description of Artificial Sequence: Synthetic oligonucleotide"
cccugacugaaaggcuucgua

SEQ ID NO: 172 - RNA, 23 nt, Artificial Sequence
  source: /note="Description of Artificial Sequence: Synthetic oligonucleotide"
uacgaagccuuucagucaggguc

SEQ ID NO: 173 - RNA, 21 nt, Artificial Sequence
  source: /note="Description of Artificial Sequence: Synthetic oligonucleotide"
ggcuucgugagaagauaucua

SEQ ID NO: 174 - RNA, 23 nt, Artificial Sequence
  source: /note="Description of Artificial Sequence: Synthetic oligonucleotide"
uagauaucuucucacgaagccuu

SEQ ID NO: 175 - RNA, 21 nt, Artificial Sequence
  source: /note="Description of Artificial Sequence: Synthetic oligonucleotide"
uggcagcaaggugacuucgga

SEQ ID NO: 176 - RNA, 23 nt, Artificial Sequence
  source: /note="Description of Artificial Sequence: Synthetic oligonucleotide"
uccgaagucaccuugcugccauc

SEQ ID NO: 177 - RNA, 21 nt, Artificial Sequence
  source: /note="Description of Artificial Sequence: Synthetic oligonucleotide"
augacccugacugaaaggcua

SEQ ID NO: 178 - RNA, 23 nt, Artificial Sequence
  source: /note="Description of Artificial Sequence: Synthetic oligonucleotide"
uagccuuucagucagggucaucc

SEQ ID NO: 179 - RNA, 21 nt, Artificial Sequence
  source: /note="Description of Artificial Sequence: Synthetic oligonucleotide"
aggaacaggaccuguggaauu

SEQ ID NO: 180 - RNA, 23 nt, Artificial Sequence
  source: /note="Description of Artificial Sequence: Synthetic oligonucleotide"
aauuccacagguccuguuccugg

SEQ ID NO: 181 - RNA, 21 nt, Artificial Sequence
  source: /note="Description of Artificial Sequence: Synthetic oligonucleotide"
guccagcagauauuugugaaa

SEQ ID NO: 182 - RNA, 23 nt, Artificial Sequence
  source: /note="Description of Artificial Sequence: Synthetic oligonucleotide"
uuucacaaauaucugcuggacau

SEQ ID NO: 183 - RNA, 21 nt, Artificial Sequence
  source: /note="Description of Artificial Sequence: Synthetic oligonucleotide"
caguagauguauuucguucaa

SEQ ID NO: 184 - RNA, 23 nt, Artificial Sequence
  source: /note="Description of Artificial Sequence: Synthetic oligonucleotide"
uugaacgaaauacaucuacugcc

SEQ ID NO: 185 - RNA, 21 nt, Artificial Sequence
  source: /note="Description of Artificial Sequence: Synthetic oligonucleotide"
cacgugcugagagacagcucu

SEQ ID NO: 186 - RNA, 23 nt, Artificial Sequence
  source: /note="Description of Artificial Sequence: Synthetic oligonucleotide"
agagcugucucucagcacguggu

SEQ ID NO: 187 - RNA, 21 nt, Artificial Sequence
  source: /note="Description of Artificial Sequence: Synthetic oligonucleotide"
uuccaugcugauccugacaua

SEQ ID NO: 188 - RNA, 23 nt, Artificial Sequence
  source: /note="Description of Artificial Sequence: Synthetic oligonucleotide"
uaugucaggaucagcauggaagc

SEQ ID NO: 189 - RNA, 21 nt, Artificial Sequence
  source: /note="Description of Artificial Sequence: Synthetic oligonucleotide"
caccaggaagaggauggucua

SEQ ID NO: 190 - RNA, 23 nt, Artificial Sequence
  source: /note="Description of Artificial Sequence: Synthetic oligonucleotide"
uagaccauccucuuccuggugua

SEQ ID NO: 191 - RNA, 21 nt, Artificial Sequence
  source: /note="Description of Artificial Sequence: Synthetic oligonucleotide"
caggaagaggauggucuccua

SEQ ID NO: 192 - RNA, 23 nt, Artificial Sequence
  source: /note="Description of Artificial Sequence: Synthetic oligonucleotide"
uaggagaccauccucuuccuggu

SEQ ID NO: 193 - RNA, 21 nt, Artificial Sequence
  source: /note="Description of Artificial Sequence: Synthetic oligonucleotide"
aucaucuuguuugccuacaua

SEQ ID NO: 194 - RNA, 23 nt, Artificial Sequence
  source: /note="Description of Artificial Sequence: Synthetic oligonucleotide"
uauguaggcaaacaagaugaugu

SEQ ID NO: 195 - RNA, 21 nt, Artificial Sequence
  source: /note="Description of Artificial Sequence: Synthetic oligonucleotide"
caucuuguuugccuacaucua

SEQ ID NO: 196 - RNA, 23 nt, Artificial Sequence
  source: /note="Description of Artificial Sequence: Synthetic oligonucleotide"
uagauguaggcaaacaagaugau

SEQ ID NO: 197 - RNA, 21 nt, Artificial Sequence
  source: /note="Description of Artificial Sequence: Synthetic oligonucleotide"
ucuuguuugccuacaucuacu

SEQ ID NO: 198 - RNA, 23 nt, Artificial Sequence
  source: /note="Description of Artificial Sequence: Synthetic oligonucleotide"
aguagauguaggcaaacaagaug

SEQ ID NO: 199 - RNA, 21 nt, Artificial Sequence
  source: /note="Description of Artificial Sequence: Synthetic oligonucleotide"
gaagaucgacauggucaagua

SEQ ID NO: 200 - RNA, 23 nt, Artificial Sequence
  source: /note="Description of Artificial Sequence: Synthetic oligonucleotide"
uacuugaccaugucgaucuuccg

SEQ ID NO: 201 - RNA, 21 nt, Artificial Sequence
  source: /note="Description of Artificial Sequence: Synthetic oligonucleotide"
gcucaccaagucagugguaua

SEQ ID NO: 202 - RNA, 23 nt, Artificial Sequence
  source: /note="Description of Artificial Sequence: Synthetic oligonucleotide"
uauaccacugacuuggugagcac

SEQ ID NO: 203 - RNA, 21 nt, Artificial Sequence
  source: /note="Description of Artificial Sequence: Synthetic oligonucleotide"
caccaagucagugguaucaaa

SEQ ID NO: 204 - RNA, 23 nt, Artificial Sequence
  source: /note="Description of Artificial Sequence: Synthetic oligonucleotide"
uuugauaccacugacuuggugag

SEQ ID NO: 205 - RNA, 21 nt, Artificial Sequence
  source: /note="Description of Artificial Sequence: Synthetic oligonucleotide"
cucaauggcggcgagauuuua

SEQ ID NO: 206 - RNA, 23 nt, Artificial Sequence
  source: /note="Description of Artificial Sequence: Synthetic oligonucleotide"
uaaaaucucgccgccauugaggg

SEQ ID NO: 207 - RNA, 21 nt, Artificial Sequence
  source: /note="Description of Artificial Sequence: Synthetic oligonucleotide"
uaccuuguggugguuauugga

SEQ ID NO: 208 - RNA, 23 nt, Artificial Sequence
  source: /note="Description of Artificial Sequence: Synthetic oligonucleotide"
uccaauaaccaccacaagguagg

SEQ ID NO: 209 - RNA, 21 nt, Artificial Sequence
  source: /note="Description of Artificial Sequence: Synthetic oligonucleotide"
ugguuauuggguuagagaaua

SEQ ID NO: 210 - RNA, 23 nt, Artificial Sequence
  source: /note="Description of Artificial Sequence: Synthetic oligonucleotide"
uauucucuaacccaauaaccacc

SEQ ID NO: 211 - RNA, 21 nt, Artificial Sequence
  source: /note="Description of Artificial Sequence: Synthetic oligonucleotide"
guuauuggguuagagaaugua

SEQ ID NO: 212 - RNA, 23 nt, Artificial Sequence
  source: /note="Description of Artificial Sequence: Synthetic oligonucleotide"
uacauucucuaacccaauaacca

SEQ ID NO: 213 - RNA, 21 nt, Artificial Sequence
  source: /note="Description of Artificial Sequence: Synthetic oligonucleotide"
guuagagaauguguuggugcu

SEQ ID NO: 214 - RNA, 23 nt, Artificial Sequence
  source: /note="Description of Artificial Sequence: Synthetic oligonucleotide"
agcaccaacacauucucuaaccc

SEQ ID NO: 215 - RNA, 21 nt, Artificial Sequence
  source: /note="Description of Artificial Sequence: Synthetic oligonucleotide"
cugacugaaaggcuucgugaa

SEQ ID NO: 216 - RNA, 23 nt, Artificial Sequence
  source: /note="Description of Artificial Sequence: Synthetic oligonucleotide"
uucacgaagccuuucagucaggg

SEQ ID NO: 217 - RNA, 21 nt, Artificial Sequence
  source: /note="Description of Artificial Sequence: Synthetic oligonucleotide"
accguugucuggauuggcaua

SEQ ID NO: 218 - RNA, 23 nt, Artificial Sequence
  source: /note="Description of Artificial Sequence: Synthetic oligonucleotide"
uaugccaauccagacaacggugc

SEQ ID NO: 219 - RNA, 21 nt, Artificial Sequence
  source: /note="Description of Artificial Sequence: Synthetic oligonucleotide"
acuuuggaggaaauuguccuu

SEQ ID NO: 220 - RNA, 23 nt, Artificial Sequence
  source: /note="Description of Artificial Sequence: Synthetic oligonucleotide"
aaggacaauuuccuccaaaguuc

SEQ ID NO: 221 - RNA, 21 nt, Artificial Sequence
  source: /note="Description of Artificial Sequence: Synthetic oligonucleotide"
uuuggaggaaauuguccuuca

SEQ ID NO: 222 - RNA, 23 nt, Artificial Sequence
  source: /note="Description of Artificial Sequence: Synthetic oligonucleotide"
ugaaggacaauuuccuccaaagu

SEQ ID NO: 223 - RNA, 21 nt, Artificial Sequence
  source: /note="Description of Artificial Sequence: Synthetic oligonucleotide"
ggagagcugggaacgacuuua

SEQ ID NO: 224 - RNA, 23 nt, Artificial Sequence
  source: /note="Description of Artificial Sequence: Synthetic oligonucleotide"
uaaagucguucccagcucuccug

SEQ ID NO: 225 - RNA, 21 nt, Artificial Sequence
  source: /note="Description of Artificial Sequence: Synthetic oligonucleotide"
agcugggaacgacuuucagau

SEQ ID NO: 226 - RNA, 23 nt, Artificial Sequence
  source: /note="Description of Artificial Sequence: Synthetic oligonucleotide"
aucugaaagucguucccagcucu

SEQ ID NO: 227 - RNA, 21 nt, Artificial Sequence
  source: /note="Description of Artificial Sequence: Synthetic oligonucleotide"
cgacuuucagauggugggaaa

SEQ ID NO: 228 - RNA, 23 nt, Artificial Sequence
  source: /note="Description of Artificial Sequence: Synthetic oligonucleotide"
uuucccaccaucugaaagucguu

SEQ ID NO: 229 - RNA, 21 nt, Artificial Sequence
  source: /note="Description of Artificial Sequence: Synthetic oligonucleotide"
accugcuuaauugacaccaaa

SEQ ID NO: 230 - RNA, 23 nt, Artificial Sequence
  source: /note="Description of Artificial Sequence: Synthetic oligonucleotide"
uuuggugucaauuaagcagguga

SEQ ID NO: 231 - RNA, 21 nt, Artificial Sequence
  source: /note="Description of Artificial Sequence: Synthetic oligonucleotide"
gcuuaauugacaccaacuuuu

SEQ ID NO: 232 - RNA, 23 nt, Artificial Sequence
  source: /note="Description of Artificial Sequence: Synthetic oligonucleotide"
aaaaguuggugucaauuaagcag

SEQ ID NO: 233 - RNA, 21 nt, Artificial Sequence
  source: /note="Description of Artificial Sequence: Synthetic oligonucleotide"
gggagccaagaccauacucua

SEQ ID NO: 234 - RNA, 23 nt, Artificial Sequence
  source: /note="Description of Artificial Sequence: Synthetic oligonucleotide"
uagaguauggucuuggcucccug

SEQ ID NO: 235 - RNA, 21 nt, Artificial Sequence
  source: /note="Description of Artificial Sequence: Synthetic oligonucleotide"
acccaucacagcccugaaaga

SEQ ID NO: 236 - RNA, 23 nt, Artificial Sequence
  source: /note="Description of Artificial Sequence: Synthetic oligonucleotide"
ucuuucagggcugugauggguuu

SEQ ID NO: 237 - RNA, 21 nt, Artificial Sequence
  source: /note="Description of Artificial Sequence: Synthetic oligonucleotide"
acagcuguguacauugaucaa

SEQ ID NO: 238 - RNA, 23 nt, Artificial Sequence
  source: /note="Description of Artificial Sequence: Synthetic oligonucleotide"
uugaucaauguacacagcuguga

SEQ ID NO: 239 - RNA, 21 nt, Artificial Sequence
  source: /note="Description of Artificial Sequence: Synthetic oligonucleotide"
agcuguguacauugaucagaa

SEQ ID NO: 240 - RNA, 23 nt, Artificial Sequence
  source: /note="Description of Artificial Sequence: Synthetic oligonucleotide"
uucugaucaauguacacagcugu

SEQ ID NO: 241 - RNA, 21 nt, Artificial Sequence
  source: /note="Description of Artificial Sequence: Synthetic oligonucleotide"
cugccugugggauguacuaaa

SEQ ID NO: 242 - RNA, 23 nt, Artificial Sequence
  source: /note="Description of Artificial Sequence: Synthetic oligonucleotide"
uuuaguacaucccacaggcagau

SEQ ID NO: 243 - RNA, 21 nt, Artificial Sequence
  source: /note="Description of Artificial Sequence: Synthetic oligonucleotide"
aguggccuggaugacuucaua

SEQ ID NO: 244 - RNA, 23 nt, Artificial Sequence
  source: /note="Description of Artificial Sequence: Synthetic oligonucleotide"
uaugaagucauccaggccacuac

SEQ ID NO: 245 - RNA, 21 nt, Artificial Sequence
  source: /note="Description of Artificial Sequence: Synthetic oligonucleotide"
cuccuuuugggaccuaaacua

SEQ ID NO: 246 - RNA, 23 nt, Artificial Sequence
  source: /note="Description of Artificial Sequence: Synthetic oligonucleotide"
uaguuuaggucccaaaaggagac

SEQ ID NO: 247 - RNA, 21 nt, Artificial Sequence
  source: /note="Description of Artificial Sequence: Synthetic oligonucleotide"
ccuuuugggaccuaaacuaua

SEQ ID NO: 248 - RNA, 23 nt, Artificial Sequence
  source: /note="Description of Artificial Sequence: Synthetic oligonucleotide"
uauaguuuaggucccaaaaggag

SEQ ID NO: 249 - RNA, 21 nt, Artificial Sequence
  source: /note="Description of Artificial Sequence: Synthetic oligonucleotide"
aagcuugggugucaucucaga

SEQ ID NO: 250 - RNA, 23 nt, Artificial Sequence
  source: /note="Description of Artificial Sequence: Synthetic oligonucleotide"
ucugagaugacacccaagcuugc

SEQ ID NO: 251 - RNA, 21 nt, Artificial Sequence
  source: /note="Description of Artificial Sequence: Synthetic oligonucleotide"
agggcugugucuccuuuugga

SEQ ID NO: 252 - RNA, 23 nt, Artificial Sequence
  source: /note="Description of Artificial Sequence: Synthetic oligonucleotide"
uccaaaaggagacacagcccugg

SEQ ID NO: 253 - RNA, 21 nt, Artificial Sequence
  source: /note="Description of Artificial Sequence: Synthetic oligonucleotide"
gcugccauugucugcaacuuu

SEQ ID NO: 254 - RNA, 23 nt, Artificial Sequence
  source: /note="Description of Artificial Sequence: Synthetic oligonucleotide"
aaaguugcagacaauggcagcgu

SEQ ID NO: 255 - RNA, 21 nt, Artificial Sequence
  source: /note="Description of Artificial Sequence: Synthetic oligonucleotide"
cugccauugucugcaacuuua

SEQ ID NO: 256 - RNA, 23 nt, Artificial Sequence
  source: /note="Description of Artificial Sequence: Synthetic oligonucleotide"
uaaaguugcagacaauggcagcg

SEQ ID NO: 257 - RNA, 21 nt, Artificial Sequence
  source: /note="Description of Artificial Sequence: Synthetic oligonucleotide"
aacuuuggcagugagcucaga

SEQ ID NO: 258 - RNA, 23 nt, Artificial Sequence
  source: /note="Description of Artificial Sequence: Synthetic oligonucleotide"
ucugagcucacugccaaaguugc

SEQ ID NO: 259 - RNA, 21 nt, Artificial Sequence
  source: /note="Description of Artificial Sequence: Synthetic oligonucleotide"
ucuccugacuguaauaauaaa

SEQ ID NO: 260 - RNA, 23 nt, Artificial Sequence
  source: /note="Description of Artificial Sequence: Synthetic oligonucleotide"
uuuauuauuacagucaggagaca

SEQ ID NO: 261 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaucugucaggcacuuuatt

SEQ ID NO: 262 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaagugccugacagaugatt

SEQ ID NO: 263 - RNA, 19 nt, Artificial Sequence
  source: /note="Description of Artificial Sequence: Synthetic oligonucleotide"
ucaucugucaggcacuuug

SEQ ID NO: 264 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaaaaaaccauaucaucatt

SEQ ID NO: 265 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaugauaugguuuuuuaatt

SEQ ID NO: 266 - RNA, 19 nt, Artificial Sequence
  source: /note="Description of Artificial Sequence: Synthetic oligonucleotide"
uuaaaaaaccauaucauca

SEQ ID NO: 267 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauaauauuaaacuuuuuutt

SEQ ID NO: 268 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaaaguuuaauauuauutt

SEQ ID NO: 269 - RNA, 19 nt, Artificial Sequence
  source: /note="Description of Artificial Sequence: Synthetic oligonucleotide"
aauaauauuaaacuuuuuu

SEQ ID NO: 270 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcugccuccugacuguaatt

SEQ ID NO: 271 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuacagucaggaggcagcgtt

SEQ ID NO: 272 - RNA, 19 nt, Artificial Sequence
  source: /note="Description of Artificial Sequence: Synthetic oligonucleotide"
cgcugccuccugacuguaa

SEQ ID NO: 273 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguaucuuccagccgcugatt

SEQ ID NO: 274 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcggcuggaagauacutt

SEQ ID NO: 275 - RNA, 19 nt, Artificial Sequence
  source: /note="Description of Artificial Sequence: Synthetic oligonucleotide"
aguaucuuccagccgcugc

SEQ ID NO: 276 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugggggaaagagccgagutt

SEQ ID NO: 277 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucggcucuuucccccaatt

SEQ ID NO: 278 - RNA, 19 nt, Artificial Sequence
  source: /note="Description of Artificial Sequence: Synthetic oligonucleotide"
uugggggaaagagccgagu

SEQ ID NO: 279 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaugcacugaaccuggaatt

SEQ ID NO: 280 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccagguucagugcauugtt

SEQ ID NO: 281 - RNA, 19 nt, Artificial Sequence
  source: /note="Description of Artificial Sequence: Synthetic oligonucleotide"
caaugcacugaaccuggac

SEQ ID NO: 282 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggccaaugcacugaaccutt

SEQ ID NO: 283 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguucagugcauuggccctt

SEQ ID NO: 284 - RNA, 19 nt, Artificial Sequence
  source: /note="Description of Artificial Sequence: Synthetic oligonucleotide"
gggccaaugcacugaaccu

SEQ ID NO: 285 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggggugcuguguggggatt

SEQ ID NO: 286 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccccacacagcaccccagtt

SEQ ID NO: 287 - RNA, 19 nt, Artificial Sequence
  source: /note="Description of Artificial Sequence: Synthetic oligonucleotide"
cuggggugcuguguggggg

SEQ ID NO: 288 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcccaggcaggaggcuatt

SEQ ID NO: 289 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagccuccugccugggcaatt

SEQ ID NO: 290 - RNA, 19 nt, Artificial Sequence
  source: /note="Description of Artificial Sequence: Synthetic oligonucleotide"
uugcccaggcaggaggcug

SEQ ID NO: 291 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuccuugcccaggcaggatt

SEQ ID NO: 292 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugccugggcaaggaggtt

SEQ ID NO: 293 - RNA, 19 nt, Artificial Sequence
  source: /note="Description of Artificial Sequence: Synthetic oligonucleotide"
ccuccuugcccaggcagga

SEQ ID NO: 294 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacugagcgcagggccutt

SEQ ID NO: 295 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcccugcgcucaguccatt

SEQ ID NO: 296 - RNA, 19 nt, Artificial Sequence
  source: /note="Description of Artificial Sequence: Synthetic oligonucleotide"
uggacugagcgcagggccu

SEQ ID NO: 297 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucugugcuggagaagcuatt

SEQ ID NO: 298 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcuucuccagcacagagtt

SEQ ID NO: 299 - RNA, 19 nt, Artificial Sequence
  source: /note="Description of Artificial Sequence: Synthetic oligonucleotide"
cucugugcuggagaagcug

SEQ ID NO: 300 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccauugucugcaacuuutt

SEQ ID NO: 301 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaguugcagacaauggcatt

SEQ ID NO: 302 - RNA, 19 nt, Artificial Sequence
  source: /note="Description of Artificial Sequence: Synthetic oligonucleotide"
ugccauugucugcaacuuu

SEQ ID NO: 303 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggugcuggacaacgcuatt

SEQ ID NO: 304 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcguuguccagcaccagtt

SEQ ID NO: 305 - RNA, 19 nt, Artificial Sequence
  source: /note="Description of Artificial Sequence: Synthetic oligonucleotide"
cuggugcuggacaacgcug

SEQ ID NO: 306 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccagauccuggugcuggatt

SEQ ID NO: 307 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccagcaccaggaucuggctt

SEQ ID NO: 308 - RNA, 19 nt, Artificial Sequence
  source: /note="Description of Artificial Sequence: Synthetic oligonucleotide"
gccagauccuggugcugga

SEQ ID NO: 309 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggcccagccugcccgcatt

SEQ ID NO: 310 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcgggcaggcugggccuctt

SEQ ID NO: 311 - RNA, 19 nt, Artificial Sequence
  source: /note="Description of Artificial Sequence: Synthetic oligonucleotide"
gaggcccagccugcccgcc

SEQ ID NO: 312 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuggggaagaacagugaatt

SEQ ID NO: 313 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucacuguucuuccccaggtt

SEQ ID NO: 314 - RNA, 19 nt, Artificial Sequence
  source: /note="Description of Artificial Sequence: Synthetic oligonucleotide"
ccuggggaagaacagugag

SEQ ID NO: 315 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuacagacagucuaccutt

SEQ ID NO: 316 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguagacugucuguaacatt

SEQ ID NO: 317 - RNA, 19 nt, Artificial Sequence
  source: /note="Description of Artificial Sequence: Synthetic oligonucleotide"
uguuacagacagucuaccu

SEQ ID NO: 318 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugucuccuuuugggaccutt

SEQ ID NO: 319 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggucccaaaaggagacactt

SEQ ID NO: 320 - RNA, 19 nt, Artificial Sequence
  source: /note="Description of Artificial Sequence: Synthetic oligonucleotide"
gugucuccuuuugggaccu

SEQ ID NO: 321 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacuggcggccagggcugutt

SEQ ID NO: 322 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagcccuggccgccaguctt

SEQ ID NO: 323 - RNA, 19 nt, Artificial Sequence
  source: /note="Description of Artificial Sequence: Synthetic oligonucleotide"
gacuggcggccagggcugu

SEQ ID NO: 324 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaaccugcuggugacugatt

SEQ ID NO: 325 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagucaccagcagguugutt

SEQ ID NO: 326 - RNA, 19 nt, Artificial Sequence
  source: /note="Description of Artificial Sequence: Synthetic oligonucleotide"
acaaccugcuggugacugg

SEQ ID NO: 327 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugggugucaucucagacatt

SEQ ID NO: 328 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucugagaugacacccaatt

SEQ ID NO: 329 - RNA, 19 nt, Artificial Sequence
  source: /note="Description of Artificial Sequence: Synthetic oligonucleotide"
uugggugucaucucagaca

SEQ ID NO: 330 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcuugggugucaucucatt

SEQ ID NO: 331 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagaugacacccaagcuutt

SEQ ID NO: 332 - RNA, 19 nt, Artificial Sequence
  source: /note="Description of Artificial Sequence: Synthetic oligonucleotide"
aagcuugggugucaucuca

SEQ ID NO: 333 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accugggcuguggugcaaatt

SEQ ID NO: 334 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugcaccacagcccaggutt

SEQ ID NO: 335 - RNA, 19 nt, Artificial Sequence
  source: /note="Description of Artificial Sequence: Synthetic oligonucleotide"
accugggcuguggugcaag

SEQ ID NO: 336 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacaggcaucaaguucuatt

SEQ ID NO: 337 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagaacuugaugccugugctt

SEQ ID NO: 338 - RNA, 19 nt, Artificial Sequence
  source: /note="Description of Artificial Sequence: Synthetic oligonucleotide"
gcacaggcaucaaguucua

SEQ ID NO: 339 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcaucugggaccgcagatt

SEQ ID NO: 340 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcggucccagaugcugtt

SEQ ID NO: 341 - RNA, 19 nt, Artificial Sequence
  source: /note="Description of Artificial Sequence: Synthetic oligonucleotide"
cagcaucugggaccgcagc

SEQ ID NO: 342 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggccuggaugaccucaucatt

SEQ ID NO: 343 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaugaggucauccaggcctt

SEQ ID NO: 344 - RNA, 19 nt, Artificial Sequence
  source: /note="Description of Artificial Sequence: Synthetic oligonucleotide"
ggccuggaugaccucauca

SEQ ID NO: 345 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugugucaucagcagugatt

SEQ ID NO: 346 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacugcugaugacacaggtt

SEQ ID NO: 347 - RNA, 19 nt, Artificial Sequence
  source: /note="Description of Artificial Sequence: Synthetic oligonucleotide"
ccugugucaucagcagugg

SEQ ID NO: 348 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccuguaccaccuccugutt

SEQ ID NO: 349 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaggaggugguacagguatt

SEQ ID NO: 350 - RNA, 19 nt, Artificial Sequence
  source: /note="Description of Artificial Sequence: Synthetic oligonucleotide"
uaccuguaccaccuccugu

SEQ ID NO: 351 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggggaugucaccucccuuatt

SEQ ID NO: 352 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagggaggugacaucccctt

SEQ ID NO: 353 - RNA, 19 nt, Artificial Sequence
  source: /note="Description of Artificial Sequence: Synthetic oligonucleotide"
ggggaugucaccucccuua

SEQ ID NO: 354 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcucaccguggggaugutt

SEQ ID NO: 355 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauccccacggugagcaatt

SEQ ID NO: 356 - RNA, 19 nt, Artificial Sequence
  source: /note="Description of Artificial Sequence: Synthetic oligonucleotide"
uugcucaccguggggaugu

SEQ ID NO: 357 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccgggucagccaugugutt

SEQ ID NO: 358 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacauggcugacccggcutt

SEQ ID NO: 359 - RNA, 19 nt, Artificial Sequence
  source: /note="Description of Artificial Sequence: Synthetic oligonucleotide"
agccgggucagccaugugu

SEQ ID NO: 360 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugccugugggauguacutt

SEQ ID NO: 361 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguacaucccacaggcagatt

SEQ ID NO: 362 - RNA, 19 nt, Artificial Sequence
  source: /note="Description of Artificial Sequence: Synthetic oligonucleotide"
ucugccugugggauguacu

SEQ ID NO: 363 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggacaagauggggccauatt

SEQ ID NO: 364 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauggccccaucuuguccutt

SEQ ID NO: 365 - RNA, 19 nt, Artificial Sequence
  source: /note="Description of Artificial Sequence: Synthetic oligonucleotide"
aggacaagauggggccauc

SEQ ID NO: 366 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggugcuggccaguggaatt

SEQ ID NO: 367 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccacuggccagcaccautt

SEQ ID NO: 368 - RNA, 19 nt, Artificial Sequence
  source: /note="Description of Artificial Sequence: Synthetic oligonucleotide"
auggugcuggccaguggag

SEQ ID NO: 369 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucacgaccguguacauutt

SEQ ID NO: 370 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauguacacggucgugaugtt

SEQ ID NO: 371 - RNA, 19 nt, Artificial Sequence
  source: /note="Description of Artificial Sequence: Synthetic oligonucleotide"
caucacgaccguguacauu

SEQ ID NO: 372 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucaggggccaucacgaatt

SEQ ID NO: 373 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgugauggccccugagutt

SEQ ID NO: 374 - RNA, 19 nt, Artificial Sequence
  source: /note="Description of Artificial Sequence: Synthetic oligonucleotide"
acucaggggccaucacgac

SEQ ID NO: 375 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucacccuucagggccacutt

SEQ ID NO: 376 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguggcccugaagggugaatt

SEQ ID NO: 377 - RNA, 19 nt, Artificial Sequence
  source: /note="Description of Artificial Sequence: Synthetic oligonucleotide"
uucacccuucagggccacu

SEQ ID NO: 378 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggacucgugcugccucuutt

SEQ ID NO: 379 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaggcagcacgaguccutt

SEQ ID NO: 380 - RNA, 19 nt, Artificial Sequence
  source: /note="Description of Artificial Sequence: Synthetic oligonucleotide"
aggacucgugcugccucuu

SEQ ID NO: 381 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccgucuggaggacucgutt

SEQ ID NO: 382 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgaguccuccagacggaatt

SEQ ID NO: 383 - RNA, 19 nt, Artificial Sequence
  source: /note="Description of Artificial Sequence: Synthetic oligonucleotide"
uuccgucuggaggacucgu

SEQ ID NO: 384 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguguuccgucuggaggaatt

SEQ ID NO: 385 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccuccagacggaacacutt

SEQ ID NO: 386 - RNA, 19 nt, Artificial Sequence
  source: /note="Description of Artificial Sequence: Synthetic oligonucleotide"
aguguuccgucuggaggac

SEQ ID NO: 387 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaccacacacugagagutt

SEQ ID NO: 388 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucucaguguguggucuutt

SEQ ID NO: 389 - RNA, 19 nt, Artificial Sequence
  source: /note="Description of Artificial Sequence: Synthetic oligonucleotide"
aagaccacacacugagagu

SEQ ID NO: 390 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggugacugggagccaaatt

SEQ ID NO: 391 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuggcucccagucaccaatt

SEQ ID NO: 392 - RNA, 19 nt, Artificial Sequence
  source: /note="Description of Artificial Sequence: Synthetic oligonucleotide"
uuggugacugggagccaag

SEQ ID NO: 393 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggcgcuuggugacugggatt

SEQ ID NO: 394 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccagucaccaagcgccctt

SEQ ID NO: 395 - RNA, 19 nt, Artificial Sequence
  source: /note="Description of Artificial Sequence: Synthetic oligonucleotide"
gggcgcuuggugacuggga

SEQ ID NO: 396 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugaaagccgcugcuggatt

SEQ ID NO: 397 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccagcagcggcuuucaggtt

SEQ ID NO: 398 - RNA, 19 nt, Artificial Sequence
  source: /note="Description of Artificial Sequence: Synthetic oligonucleotide"
ccugaaagccgcugcuggg

SEQ ID NO: 399 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaacccaucacagcccutt

SEQ ID NO: 400 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggcugugauggguuuuutt

SEQ ID NO: 401 - RNA, 19 nt, Artificial Sequence
  source: /note="Description of Artificial Sequence: Synthetic oligonucleotide"
aaaaacccaucacagcccu

SEQ ID NO: 402 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugcccugugcacaccaatt

SEQ ID NO: 403 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggugugcacagggcacutt

SEQ ID NO: 404 - RNA, 19 nt, Artificial Sequence
  source: /note="Description of Artificial Sequence: Synthetic oligonucleotide"
agugcccugugcacaccaa

SEQ ID NO: 405 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacccacacagugcccugutt

SEQ ID NO: 406 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagggcacuguguggguctt

SEQ ID NO: 407 - RNA, 19 nt, Artificial Sequence
  source: /note="Description of Artificial Sequence: Synthetic oligonucleotide"
gacccacacagugcccugu

SEQ ID NO: 408 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacagcagcagcgacacaatt

SEQ ID NO: 409 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugugucgcugcugcuguatt

SEQ ID NO: 410 - RNA, 19 nt, Artificial Sequence
  source: /note="Description of Artificial Sequence: Synthetic oligonucleotide"
uacagcagcagcgacacag

SEQ ID NO: 411 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccccugccucuccaguguatt

SEQ ID NO: 412 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacacuggagaggcaggggtt

SEQ ID NO: 413 - RNA, 19 nt, Artificial Sequence
  source: /note="Description of Artificial Sequence: Synthetic oligonucleotide"
ccccugccucuccagugua

SEQ ID NO: 414 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcggggcaguuccccugcatt

SEQ ID NO: 415 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaggggaacugccccgctt

SEQ ID NO: 416 - RNA, 19 nt, Artificial Sequence
  source: /note="Description of Artificial Sequence: Synthetic oligonucleotide"
gcggggcaguuccccugcc

SEQ ID NO: 417 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuagagggaccccagggcatt

SEQ ID NO: 418 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccuggggucccucuaatt

SEQ ID NO: 419 - RNA, 19 nt, Artificial Sequence
  source: /note="Description of Artificial Sequence: Synthetic oligonucleotide"
uuagagggaccccagggcg

SEQ ID NO: 420 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccucagcccccugcaguutt

SEQ ID NO: 421 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacugcagggggcugagggtt

SEQ ID NO: 422 - RNA, 19 nt, Artificial Sequence
  source: /note="Description of Artificial Sequence: Synthetic oligonucleotide"
cccucagcccccugcaguu

SEQ ID NO: 423 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggagacccacacugccatt

SEQ ID NO: 424 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcagugugggucuccaatt

SEQ ID NO: 425 - RNA, 19 nt, Artificial Sequence
  source: /note="Description of Artificial Sequence: Synthetic oligonucleotide"
uuggagacccacacugccc

SEQ ID NO: 426 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccuugauuucuucuccuutt

SEQ ID NO: 427 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggagaagaaaucaagggtt

SEQ ID NO: 428 - RNA, 19 nt, Artificial Sequence
  source: /note="Description of Artificial Sequence: Synthetic oligonucleotide"
cccuugauuucuucuccuu

SEQ ID NO: 429 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcacggcucaacgguucatt

SEQ ID NO: 430 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaccguugagccgugcatt

SEQ ID NO: 431 - RNA, 19 nt, Artificial Sequence
  source: /note="Description of Artificial Sequence: Synthetic oligonucleotide"
ugcacggcucaacgguucc

SEQ ID NO: 432 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuuggacaaaaggauuatt

SEQ ID NO: 433 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaauccuuuuguccaagaatt

SEQ ID NO: 434 - RNA, 19 nt, Artificial Sequence
  source: /note="Description of Artificial Sequence: Synthetic oligonucleotide"
uucuuggacaaaaggauug

SEQ ID NO: 435 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcucugguguucuuggaatt

SEQ ID NO: 436 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccaagaacaccagagcgtt

SEQ ID NO: 437 - RNA, 19 nt, Artificial Sequence
  source: /note="Description of Artificial Sequence: Synthetic oligonucleotide"
cgcucugguguucuuggac

SEQ ID NO: 438 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccucaggcauuaccgatt

SEQ ID NO: 439 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgguaaugccugaggagatt

SEQ ID NO: 440 - RNA, 19 nt, Artificial Sequence
  source: /note="Description of Artificial Sequence: Synthetic oligonucleotide"
ucuccucaggcauuaccgc

SEQ ID NO: 441 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcagcagcgaggaggucutt

SEQ ID NO: 442 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaccuccucgcugcugcatt

SEQ ID NO: 443 - RNA, 19 nt, Artificial Sequence
  source: /note="Description of Artificial Sequence: Synthetic oligonucleotide"
ugcagcagcgaggaggucu

SEQ ID NO: 444 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgccauugaaggggugcutt

SEQ ID NO: 445 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaccccuucaauggcgutt

SEQ ID NO: 446 - RNA, 19 nt, Artificial Sequence
  source: /note="Description of Artificial Sequence: Synthetic oligonucleotide"
acgccauugaaggggugcu

SEQ ID NO: 447 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcggagcagcggccggcuatt

SEQ ID NO: 448 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagccggccgcugcuccgctt

SEQ ID NO: 449 - RNA, 19 nt, Artificial Sequence
  source: /note="Description of Artificial Sequence: Synthetic oligonucleotide"
gcggagcagcggccggcug

SEQ ID NO: 450 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accucaucgugguggggcatt

SEQ ID NO: 451 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccccaccacgaugaggutt

SEQ ID NO: 452 - RNA, 19 nt, Artificial Sequence
  source: /note="Description of Artificial Sequence: Synthetic oligonucleotide"
accucaucgugguggggcg

SEQ ID NO: 453 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggagcugcagggcaacatt

SEQ ID NO: 454 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguugcccugcagcuccaatt

SEQ ID NO: 455 - RNA, 19 nt, Artificial Sequence
  source: /note="Description of Artificial Sequence: Synthetic oligonucleotide"
uuggagcugcagggcaacc

SEQ ID NO: 456 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggguuccaucuggagcuutt

SEQ ID NO: 457 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcuccagauggaacccutt

SEQ ID NO: 458 - RNA, 19 nt, Artificial Sequence
  source: /note="Description of Artificial Sequence: Synthetic oligonucleotide"
aggguuccaucuggagcuu

SEQ ID NO: 459 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccagugccgaggguuccatt

SEQ ID NO: 460 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaacccucggcacugggtt

SEQ ID NO: 461 - RNA, 19 nt, Artificial Sequence
  source: /note="Description of Artificial Sequence: Synthetic oligonucleotide"
cccagugccgaggguucca

SEQ ID NO: 462 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucccucgccugggccccatt

SEQ ID NO: 463 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggggcccaggcgagggaatt

SEQ ID NO: 464 - RNA, 19 nt, Artificial Sequence
  source: /note="Description of Artificial Sequence: Synthetic oligonucleotide"
uucccucgccugggccccc

SEQ ID NO: 465 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccgagaaaggcuccccuutt

SEQ ID NO: 466 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggggagccuuucucgggtt

SEQ ID NO: 467 - RNA, 19 nt, Artificial Sequence
  source: /note="Description of Artificial Sequence: Synthetic oligonucleotide"
cccgagaaaggcuccccuu

SEQ ID NO: 468 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcucccccgagaaaggcuatt

SEQ ID NO: 469 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagccuuucucgggggagctt

SEQ ID NO: 470 - RNA, 19 nt, Artificial Sequence
  source: /note="Description of Artificial Sequence: Synthetic oligonucleotide"
gcucccccgagaaaggcuc

SEQ ID NO: 471 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugaggacgaggguggcutt

SEQ ID NO: 472 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccacccucguccucaggtt

SEQ ID NO: 473 - RNA, 19 nt, Artificial Sequence
  source: /note="Description of Artificial Sequence: Synthetic oligonucleotide"
ccugaggacgaggguggcu

SEQ ID NO: 474 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggugcugucccaggcccatt

SEQ ID NO: 475 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggccugggacagcaccgtt

SEQ ID NO: 476 - RNA, 19 nt, Artificial Sequence
  source: /note="Description of Artificial Sequence: Synthetic oligonucleotide"
cggugcugucccaggcccc

SEQ ID NO: 477 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucgccugggccggugcutt

SEQ ID NO: 478 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaccggcccaggcgaggtt

SEQ ID NO: 479 - RNA, 19 nt, Artificial Sequence
  source: /note="Description of Artificial Sequence: Synthetic oligonucleotide"
ccucgccugggccggugcu

SEQ ID NO: 480 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagcccugcgcccacccutt

SEQ ID NO: 481 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggugggcgcagggcuggtt

SEQ ID NO: 482 - RNA, 19 nt, Artificial Sequence
  source: /note="Description of Artificial Sequence: Synthetic oligonucleotide"
ccagcccugcgcccacccu

SEQ ID NO: 483 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuggcggccgucugcacatt

SEQ ID NO: 484 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugcagacggccgccagctt

SEQ ID NO: 485 - RNA, 19 nt, Artificial Sequence
  source: /note="Description of Artificial Sequence: Synthetic oligonucleotide"
gcuggcggccgucugcaca

SEQ ID NO: 486 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaccaggaggaggggcutt

SEQ ID NO: 487 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccccuccuccugguacatt

SEQ ID NO: 488 - RNA, 19 nt, Artificial Sequence
  source: /note="Description of Artificial Sequence: Synthetic oligonucleotide"
uguaccaggaggaggggcu

SEQ ID NO: 489 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugccuggugcagcggguatt

SEQ ID NO: 490 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacccgcugcaccaggcagtt

SEQ ID NO: 491 - RNA, 19 nt, Artificial Sequence
  source: /note="Description of Artificial Sequence: Synthetic oligonucleotide"
cugccuggugcagcgggug

SEQ ID NO: 492 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucgggacuccccaggcutt

SEQ ID NO: 493 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccuggggagucccgagatt

SEQ ID NO: 494 - RNA, 19 nt, Artificial Sequence
  source: /note="Description of Artificial Sequence: Synthetic oligonucleotide"
ucucgggacuccccaggcu

SEQ ID NO: 495 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguggccgcucucgggacutt

SEQ ID NO: 496 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucccgagagcggccacatt

SEQ ID NO: 497 - RNA, 19 nt, Artificial Sequence
  source: /note="Description of Artificial Sequence: Synthetic oligonucleotide"
uguggccgcucucgggacu

SEQ ID NO: 498 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccggcaccgggcggucugutt

SEQ ID NO: 499 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagaccgcccggugccggtt

SEQ ID NO: 500 - RNA, 19 nt, Artificial Sequence
  source: /note="Description of Artificial Sequence: Synthetic oligonucleotide"
ccggcaccgggcggucugu

SEQ ID NO: 501 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcccgagccccggcacatt

SEQ ID NO: 502 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugccggggcucgggcugtt

SEQ ID NO: 503 - RNA, 19 nt, Artificial Sequence
  source: /note="Description of Artificial Sequence: Synthetic oligonucleotide"
cagcccgagccccggcacc

SEQ ID NO: 504 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guccucacagcccacucaatt

SEQ ID NO: 505 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugagugggcugugaggactt

SEQ ID NO: 506 - RNA, 19 nt, Artificial Sequence
  source: /note="Description of Artificial Sequence: Synthetic oligonucleotide"
guccucacagcccacucag

SEQ ID NO: 507 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucagcgcagccucgguatt

SEQ ID NO: 508 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccgaggcugcgcugaaatt

SEQ ID NO: 509 - RNA, 19 nt, Artificial Sequence
  source: /note="Description of Artificial Sequence: Synthetic oligonucleotide"
uuucagcgcagccucgguc

SEQ ID NO: 510 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaauugacaccaacuuuutt

SEQ ID NO: 511 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaguuggugucaauuaatt

SEQ ID NO: 512 - RNA, 19 nt, Artificial Sequence
  source: /note="Description of Artificial Sequence: Synthetic oligonucleotide"
uuaauugacaccaacuuuu

SEQ ID NO: 513 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accucaccugcuuaauugatt

SEQ ID NO: 514 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaauuaagcaggugaggutt

SEQ ID NO: 515 - RNA, 19 nt, Artificial Sequence
  source: /note="Description of Artificial Sequence: Synthetic oligonucleotide"
accucaccugcuuaauuga

SEQ ID NO: 516 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucggggaccagccugacatt

SEQ ID NO: 517 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucaggcugguccccgaatt

SEQ ID NO: 518 - RNA, 19 nt, Artificial Sequence
  source: /note="Description of Artificial Sequence: Synthetic oligonucleotide"
uucggggaccagccugacc

SEQ ID NO: 519 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccgccgccuucccucuutt

SEQ ID NO: 520 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagagggaaggcggcggagtt

SEQ ID NO: 521 - RNA, 19 nt, Artificial Sequence
  source: /note="Description of Artificial Sequence: Synthetic oligonucleotide"
cuccgccgccuucccucuu

SEQ ID NO: 522 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuccccugagacaccgcatt

SEQ ID NO: 523 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcggugucucaggggaggtt

SEQ ID NO: 524 - RNA, 19 nt, Artificial Sequence
  source: /note="Description of Artificial Sequence: Synthetic oligonucleotide"
ccuccccugagacaccgcc

SEQ ID NO: 525 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuaagcagcgagagcugatt

SEQ ID NO: 526 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcucucgcugcuuaggtt

SEQ ID NO: 527 - RNA, 19 nt, Artificial Sequence
  source: /note="Description of Artificial Sequence: Synthetic oligonucleotide"
ccuaagcagcgagagcugg

SEQ ID NO: 528 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcggaucgcccaaggcatt

SEQ ID NO: 529 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccuugggcgauccgcagtt

SEQ ID NO: 530 - RNA, 19 nt, Artificial Sequence
  source: /note="Description of Artificial Sequence: Synthetic oligonucleotide"
cugcggaucgcccaaggcc

SEQ ID NO: 531 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuggaggugaagcugcgatt

SEQ ID NO: 532 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcagcuucaccuccaggtt

SEQ ID NO: 533 - RNA, 19 nt, Artificial Sequence
  source: /note="Description of Artificial Sequence: Synthetic oligonucleotide"
ccuggaggugaagcugcgg

SEQ ID NO: 534 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucaaccccgguagaccutt

SEQ ID NO: 535 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggucuaccgggguugagatt

SEQ ID NO: 536 - RNA, 19 nt, Artificial Sequence
  source: /note="Description of Artificial Sequence: Synthetic oligonucleotide"
ucucaaccccgguagaccu

SEQ ID NO: 537 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagucuguggucucaaccatt

SEQ ID NO: 538 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguugagaccacagacuutt

SEQ ID NO: 539 - RNA, 19 nt, Artificial Sequence
  source: /note="Description of Artificial Sequence: Synthetic oligonucleotide"
aagucuguggucucaaccc

SEQ ID NO: 540 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauuggguuagagaaugutt

SEQ ID NO: 541 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauucucuaacccaauaatt

SEQ ID NO: 542 - RNA, 19 nt, Artificial Sequence
  source: /note="Description of Artificial Sequence: Synthetic oligonucleotide"
uuauuggguuagagaaugu

SEQ ID NO: 543 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggugguuauuggguuagaatt

SEQ ID NO: 544 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuaacccaauaaccacctt

SEQ ID NO: 545 - RNA, 19 nt, Artificial Sequence
  source: /note="Description of Artificial Sequence: Synthetic oligonucleotide"
ggugguuauuggguuagag

SEQ ID NO: 546 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuccccuaccuuguggutt

SEQ ID NO: 547 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accacaagguaggggaaaatt

SEQ ID NO: 548 - RNA, 19 nt, Artificial Sequence
  source: /note="Description of Artificial Sequence: Synthetic oligonucleotide"
uuuuccccuaccuuguggu

SEQ ID NO: 549 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucaauggcggcgagauutt

SEQ ID NO: 550 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucucgccgccauugaggtt

SEQ ID NO: 551 - RNA, 19 nt, Artificial Sequence
  source: /note="Description of Artificial Sequence: Synthetic oligonucleotide"
ccucaauggcggcgagauu

SEQ ID NO: 552 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucggccugacgcccaccatt

SEQ ID NO: 553 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggugggcgucaggccgaatt

SEQ ID NO: 554 - RNA, 19 nt, Artificial Sequence
  source: /note="Description of Artificial Sequence: Synthetic oligonucleotide"
uucggccugacgcccaccc

SEQ ID NO: 555 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcacacucuucggccugatt

SEQ ID NO: 556 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggccgaagagugugcatt

SEQ ID NO: 557 - RNA, 19 nt, Artificial Sequence
  source: /note="Description of Artificial Sequence: Synthetic oligonucleotide"
ugcacacucuucggccuga

SEQ ID NO: 558 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugucugugggacucugatt

SEQ ID NO: 559 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagagucccacagacaugtt

SEQ ID NO: 560 - RNA, 19 nt, Artificial Sequence
  source: /note="Description of Artificial Sequence: Synthetic oligonucleotide"
caugucugugggacucugc

SEQ ID NO: 561 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugcucaugucugugggatt

SEQ ID NO: 562 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccacagacaugagcagctt

SEQ ID NO: 563 - RNA, 19 nt, Artificial Sequence
  source: /note="Description of Artificial Sequence: Synthetic oligonucleotide"
gcugcucaugucuguggga

SEQ ID NO: 564 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacagugcucagcucgcutt

SEQ ID NO: 565 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcgagcugagcacugugatt

SEQ ID NO: 566 - RNA, 19 nt, Artificial Sequence
  source: /note="Description of Artificial Sequence: Synthetic oligonucleotide"
ucacagugcucagcucgcu

SEQ ID NO: 567 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcccuggcugccgugguatt

SEQ ID NO: 568 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccacggcagccagggcctt

SEQ ID NO: 569 - RNA, 19 nt, Artificial Sequence
  source: /note="Description of Artificial Sequence: Synthetic oligonucleotide"
ggcccuggcugccgugguc

SEQ ID NO: 570 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caagugggggcuggcccuatt

SEQ ID NO: 571 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagggccagcccccacuugtt

SEQ ID NO: 572 - RNA, 19 nt, Artificial Sequence
  source: /note="Description of Artificial Sequence: Synthetic oligonucleotide"
caagugggggcuggcccug

SEQ ID NO: 573 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgacauggucaaguccaatt

SEQ ID NO: 574 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggacuugaccaugucgatt

SEQ ID NO: 575 - RNA, 19 nt, Artificial Sequence
  source: /note="Description of Artificial Sequence: Synthetic oligonucleotide"
ucgacauggucaaguccaa

SEQ ID NO: 576 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuccacgcggaagaucatt

SEQ ID NO: 577 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaucuuccgcguggagaatt

SEQ ID NO: 578 - RNA, 19 nt, Artificial Sequence
  source: /note="Description of Artificial Sequence: Synthetic oligonucleotide"
uucuccacgcggaagaucg

SEQ ID NO: 579 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuugccuacaucuacuutt

SEQ ID NO: 580 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguagauguaggcaaacatt

SEQ ID NO: 581 - RNA, 19 nt, Artificial Sequence
  source: /note="Description of Artificial Sequence: Synthetic oligonucleotide"
uguuugccuacaucuacuu

SEQ ID NO: 582 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaccaccuacaucaucuuatt

SEQ ID NO: 583 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagaugauguaggugguctt

SEQ ID NO: 584 - RNA, 19 nt, Artificial Sequence
  source: /note="Description of Artificial Sequence: Synthetic oligonucleotide"
gaccaccuacaucaucuug

SEQ ID NO: 585 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucccccuugugaccacatt

SEQ ID NO: 586 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguggucacaagggggaugtt

SEQ ID NO: 587 - RNA, 19 nt, Artificial Sequence
  source: /note="Description of Artificial Sequence: Synthetic oligonucleotide"
caucccccuugugaccacc

SEQ ID NO: 588 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggugucgcugagcucautt

SEQ ID NO: 589 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augagcucagcgacaccaatt

SEQ ID NO: 590 - RNA, 19 nt, Artificial Sequence
  source: /note="Description of Artificial Sequence: Synthetic oligonucleotide"
uuggugucgcugagcucau

SEQ ID NO: 591 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacuucaaggaggagauutt

SEQ ID NO: 592 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucuccuccuugaagugctt

SEQ ID NO: 593 - RNA, 19 nt, Artificial Sequence
  source: /note="Description of Artificial Sequence: Synthetic oligonucleotide"
gcacuucaaggaggagauu

SEQ ID NO: 594 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagagccugguccacgugatt

SEQ ID NO: 595 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacguggaccaggcucuctt

SEQ ID NO: 596 - RNA, 19 nt, Artificial Sequence
  source: /note="Description of Artificial Sequence: Synthetic oligonucleotide"
gagagccugguccacgugc

SEQ ID NO: 597 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugcagccuucgggcggatt

SEQ ID NO: 598 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgcccgaaggcugcagutt

SEQ ID NO: 599 - RNA, 19 nt, Artificial Sequence
  source: /note="Description of Artificial Sequence: Synthetic oligonucleotide"
acugcagccuucgggcgga

SEQ ID NO: 600 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucugcaccccagccccaatt

SEQ ID NO: 601 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggggcuggggugcagaatt

SEQ ID NO: 602 - RNA, 19 nt, Artificial Sequence
  source: /note="Description of Artificial Sequence: Synthetic oligonucleotide"
uucugcaccccagccccaa

SEQ ID NO: 603 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugcccgccugaugcuucutt

SEQ ID NO: 604 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaagcaucaggcgggcactt

SEQ ID NO: 605 - RNA, 19 nt, Artificial Sequence
  source: /note="Description of Artificial Sequence: Synthetic oligonucleotide"
gugcccgccugaugcuucu

SEQ ID NO: 606 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccugggcagccugcguatt

SEQ ID NO: 607 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacgcaggcugcccaggaatt

SEQ ID NO: 608 - RNA, 19 nt, Artificial Sequence
  source: /note="Description of Artificial Sequence: Synthetic oligonucleotide"
uuccugggcagccugcgug

SEQ ID NO: 609 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccaaguuccugggcagatt

SEQ ID NO: 610 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcccaggaacuuggcatt

SEQ ID NO: 611 - RNA, 19 nt, Artificial Sequence
  source: /note="Description of Artificial Sequence: Synthetic oligonucleotide"
ugccaaguuccugggcagc

SEQ ID NO: 612 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuccagcacuaccaugatt

SEQ ID NO: 613 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugguagugcuggaagatt

SEQ ID NO: 614 - RNA, 19 nt, Artificial Sequence
  source: /note="Description of Artificial Sequence: Synthetic oligonucleotide"
ucuuccagcacuaccaugc

SEQ ID NO: 615 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaccaucacccuggucutt

SEQ ID NO: 616 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaccagggugaugguguatt

SEQ ID NO: 617 - RNA, 19 nt, Artificial Sequence
  source: /note="Description of Artificial Sequence: Synthetic oligonucleotide"
uacaccaucacccuggucu

SEQ ID NO: 618 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaagaggauggucuccuatt

SEQ ID NO: 619 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggagaccauccucuucctt

SEQ ID NO: 620 - RNA, 19 nt, Artificial Sequence
  source: /note="Description of Artificial Sequence: Synthetic oligonucleotide"
ggaagaggauggucuccua

SEQ ID NO: 621 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuacaccaggaagaggautt

SEQ ID NO: 622 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccucuuccugguguagatt

SEQ ID NO: 623 - RNA, 19 nt, Artificial Sequence
  source: /note="Description of Artificial Sequence: Synthetic oligonucleotide"
ucuacaccaggaagaggau

SEQ ID NO: 624 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacagcggggugagccucutt

SEQ ID NO: 625 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaggcucaccccgcuguatt

SEQ ID NO: 626 - RNA, 19 nt, Artificial Sequence
  source: /note="Description of Artificial Sequence: Synthetic oligonucleotide"
uacagcggggugagccucu

SEQ ID NO: 627 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuuguuauuugguguucatt

SEQ ID NO: 628 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaacaccaaauaacaagutt

SEQ ID NO: 629 - RNA, 19 nt, Artificial Sequence
  source: /note="Description of Artificial Sequence: Synthetic oligonucleotide"
acuuguuauuugguguucc

SEQ ID NO: 630 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagccacacucaaagacutt

SEQ ID NO: 631 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucuuugaguguggcugatt

SEQ ID NO: 632 - RNA, 19 nt, Artificial Sequence
  source: /note="Description of Artificial Sequence: Synthetic oligonucleotide"
ucagccacacucaaagacu

SEQ ID NO: 633 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcagacuucagccacacutt

SEQ ID NO: 634 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguguggcugaagucugcatt

SEQ ID NO: 635 - RNA, 19 nt, Artificial Sequence
  source: /note="Description of Artificial Sequence: Synthetic oligonucleotide"
ugcagacuucagccacacu

SEQ ID NO: 636 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacgagccuaaaacccugatt

SEQ ID NO: 637 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggguuuuaggcucgugtt

SEQ ID NO: 638 - RNA, 19 nt, Artificial Sequence
  source: /note="Description of Artificial Sequence: Synthetic oligonucleotide"
cacgagccuaaaacccugc

SEQ ID NO: 639 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaccagcacgagccuaatt

SEQ ID NO: 640 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaggcucgugcugguggatt

SEQ ID NO: 641 - RNA, 19 nt, Artificial Sequence
  source: /note="Description of Artificial Sequence: Synthetic oligonucleotide"
uccaccagcacgagccuaa

SEQ ID NO: 642 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacaucauugggaccaucatt

SEQ ID NO: 643 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauggucccaaugauguctt

SEQ ID NO: 644 - RNA, 19 nt, Artificial Sequence
  source: /note="Description of Artificial Sequence: Synthetic oligonucleotide"
gacaucauugggaccaucc

SEQ ID NO: 645 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuccaugcugauccugaatt

SEQ ID NO: 646 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaggaucagcauggaagtt

SEQ ID NO: 647 - RNA, 19 nt, Artificial Sequence
  source: /note="Description of Artificial Sequence: Synthetic oligonucleotide"
cuuccaugcugauccugac

SEQ ID NO: 648 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaugacugggaacgcuutt

SEQ ID NO: 649 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcguucccagucauucutt

SEQ ID NO: 650 - RNA, 19 nt, Artificial Sequence
  source: /note="Description of Artificial Sequence: Synthetic oligonucleotide"
agaaugacugggaacgcuu

SEQ ID NO: 651 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuggcagaaugacugggatt

SEQ ID NO: 652 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccagucauucugccagatt

SEQ ID NO: 653 - RNA, 19 nt, Artificial Sequence
  source: /note="Description of Artificial Sequence: Synthetic oligonucleotide"
ucuggcagaaugacuggga

SEQ ID NO: 654 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguccccugggaacuucutt

SEQ ID NO: 655 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaguucccaggggacagtt

SEQ ID NO: 656 - RNA, 19 nt, Artificial Sequence
  source: /note="Description of Artificial Sequence: Synthetic oligonucleotide"
cuguccccugggaacuucu

SEQ ID NO: 657 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugcugcuguccccuggatt

SEQ ID NO: 658 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaggggacagcagcaggtt

SEQ ID NO: 659 - RNA, 19 nt, Artificial Sequence
  source: /note="Description of Artificial Sequence: Synthetic oligonucleotide"
ccugcugcuguccccuggg

SEQ ID NO: 660 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccugagcauggaugccutt

SEQ ID NO: 661 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcauccaugcucagggatt

SEQ ID NO: 662 - RNA, 19 nt, Artificial Sequence
  source: /note="Description of Artificial Sequence: Synthetic oligonucleotide"
ucccugagcauggaugccu

SEQ ID NO: 663 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuacucccugagcauggatt

SEQ ID NO: 664 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaugcucagggaguaggtt

SEQ ID NO: 665 - RNA, 19 nt, Artificial Sequence
  source: /note="Description of Artificial Sequence: Synthetic oligonucleotide"
ccuacucccugagcaugga

SEQ ID NO: 666 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaggaagcucaggaaccutt

SEQ ID NO: 667 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguuccugagcuuccuaatt

SEQ ID NO: 668 - RNA, 19 nt, Artificial Sequence
  source: /note="Description of Artificial Sequence: Synthetic oligonucleotide"
uuaggaagcucaggaaccu

SEQ ID NO: 669 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgaccugcugccaggccuutt

SEQ ID NO: 670 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggccuggcagcaggucgtt

SEQ ID NO: 671 - RNA, 19 nt, Artificial Sequence
  source: /note="Description of Artificial Sequence: Synthetic oligonucleotide"
cgaccugcugccaggccuu

SEQ ID NO: 672 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugucugcaagugaccgatt

SEQ ID NO: 673 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucggucacuugcagacacatt

SEQ ID NO: 674 - RNA, 19 nt, Artificial Sequence
  source: /note="Description of Artificial Sequence: Synthetic oligonucleotide"
ugugucugcaagugaccga

SEQ ID NO: 675 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggagcuuggaggaguugutt

SEQ ID NO: 676 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaacuccuccaagcuccutt

SEQ ID NO: 677 - RNA, 19 nt, Artificial Sequence
  source: /note="Description of Artificial Sequence: Synthetic oligonucleotide"
aggagcuuggaggaguugu

SEQ ID NO: 678 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagacagcucugggaucaatt

SEQ ID NO: 679 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaucccagagcugucuctt

SEQ ID NO: 680 - RNA, 19 nt, Artificial Sequence
  source: /note="Description of Artificial Sequence: Synthetic oligonucleotide"
gagacagcucugggaucag

SEQ ID NO: 681 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgugcugagagacagcucutt

SEQ ID NO: 682 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagcugucucucagcacgtt

SEQ ID NO: 683 - RNA, 19 nt, Artificial Sequence
  source: /note="Description of Artificial Sequence: Synthetic oligonucleotide"
cgugcugagagacagcucu

SEQ ID NO: 684 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggagauccggaaccacatt

SEQ ID NO: 685 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugguuccggaucuccuctt

SEQ ID NO: 686 - RNA, 19 nt, Artificial Sequence
  source: /note="Description of Artificial Sequence: Synthetic oligonucleotide"
gaggagauccggaaccacg

SEQ ID NO: 687 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggcauuccaacugguggatt

SEQ ID NO: 688 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaccaguuggaaugccctt

SEQ ID NO: 689 - RNA, 19 nt, Artificial Sequence
  source: /note="Description of Artificial Sequence: Synthetic oligonucleotide"
gggcauuccaacuggugga

SEQ ID NO: 690 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucguucaccuuugucccgatt

SEQ ID NO: 691 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgggacaaaggugaacgatt

SEQ ID NO: 692 - RNA, 19 nt, Artificial Sequence
  source: /note="Description of Artificial Sequence: Synthetic oligonucleotide"
ucguucaccuuugucccgg

SEQ ID NO: 693 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guauuucguucaccuuugutt

SEQ ID NO: 694 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaaaggugaacgaaauactt

SEQ ID NO: 695 - RNA, 19 nt, Artificial Sequence
  source: /note="Description of Artificial Sequence: Synthetic oligonucleotide"
guauuucguucaccuuugu

SEQ ID NO: 696 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuccuggcaguagauguatt

SEQ ID NO: 697 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaucuacugccaggaggtt

SEQ ID NO: 698 - RNA, 19 nt, Artificial Sequence
  source: /note="Description of Artificial Sequence: Synthetic oligonucleotide"
ccuccuggcaguagaugua

SEQ ID NO: 699 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucccuggcacaagaaccutt

SEQ ID NO: 700 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguucuugugccagggaatt

SEQ ID NO: 701 - RNA, 19 nt, Artificial Sequence
  source: /note="Description of Artificial Sequence: Synthetic oligonucleotide"
uucccuggcacaagaaccu

SEQ ID NO: 702 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugaaguccucaguguuutt

SEQ ID NO: 703 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacacugaggacuucacatt

SEQ ID NO: 704 - RNA, 19 nt, Artificial Sequence
  source: /note="Description of Artificial Sequence: Synthetic oligonucleotide"
ugugaaguccucaguguuu

SEQ ID NO: 705 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauguccagcagauauuutt

SEQ ID NO: 706 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauaucugcuggacauaatt

SEQ ID NO: 707 - RNA, 19 nt, Artificial Sequence
  source: /note="Description of Artificial Sequence: Synthetic oligonucleotide"
uuauguccagcagauauuu

SEQ ID NO: 708 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccgguggcuuauguccaatt

SEQ ID NO: 709 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggacauaagccaccgggtt

SEQ ID NO: 710 - RNA, 19 nt, Artificial Sequence
  source: /note="Description of Artificial Sequence: Synthetic oligonucleotide"
cccgguggcuuauguccag

SEQ ID NO: 711 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugguaugugggugcccatt

SEQ ID NO: 712 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggcacccacauaccacutt

SEQ ID NO: 713 - RNA, 19 nt, Artificial Sequence
  source: /note="Description of Artificial Sequence: Synthetic oligonucleotide"
agugguaugugggugcccc

SEQ ID NO: 714 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuacugagcagccugagutt

SEQ ID NO: 715 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucaggcugcucaguaggtt

SEQ ID NO: 716 - RNA, 19 nt, Artificial Sequence
  source: /note="Description of Artificial Sequence: Synthetic oligonucleotide"
ccuacugagcagccugagu

SEQ ID NO: 717 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaccuguggacucugacatt

SEQ ID NO: 718 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucagaguccacagguggtt

SEQ ID NO: 719 - RNA, 19 nt, Artificial Sequence
  source: /note="Description of Artificial Sequence: Synthetic oligonucleotide"
ccaccuguggacucugacc

SEQ ID NO: 720 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuacucgcccccaccuguatt

SEQ ID NO: 721 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaggugggggcgaguaatt

SEQ ID NO: 722 - RNA, 19 nt, Artificial Sequence
  source: /note="Description of Artificial Sequence: Synthetic oligonucleotide"
uuacucgcccccaccugug

SEQ ID NO: 723 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugugaaggauuacucgatt

SEQ ID NO: 724 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgaguaauccuucacaggtt

SEQ ID NO: 725 - RNA, 19 nt, Artificial Sequence
  source: /note="Description of Artificial Sequence: Synthetic oligonucleotide"
ccugugaaggauuacucgc

SEQ ID NO: 726 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguggaauucaccaccccutt

SEQ ID NO: 727 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggguggugaauuccacatt

SEQ ID NO: 728 - RNA, 19 nt, Artificial Sequence
  source: /note="Description of Artificial Sequence: Synthetic oligonucleotide"
uguggaauucaccaccccu

SEQ ID NO: 729 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuugccaggaacaggacatt

SEQ ID NO: 730 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguccuguuccuggcaaggtt

SEQ ID NO: 731 - RNA, 19 nt, Artificial Sequence
  source: /note="Description of Artificial Sequence: Synthetic oligonucleotide"
ccuugccaggaacaggacc

SEQ ID NO: 732 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacccacugcugaaacucatt

SEQ ID NO: 733 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaguuucagcaguggguatt

SEQ ID NO: 734 - RNA, 19 nt, Artificial Sequence
  source: /note="Description of Artificial Sequence: Synthetic oligonucleotide"
uacccacugcugaaacucc

SEQ ID NO: 735 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugcuacccacugcugaatt

SEQ ID NO: 736 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucagcaguggguagcagctt

SEQ ID NO: 737 - RNA, 19 nt, Artificial Sequence
  source: /note="Description of Artificial Sequence: Synthetic oligonucleotide"
gcugcuacccacugcugaa

SEQ ID NO: 738 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucugcaucuuagccugcutt

SEQ ID NO: 739 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaggcuaagaugcagaatt

SEQ ID NO: 740 - RNA, 19 nt, Artificial Sequence
  source: /note="Description of Artificial Sequence: Synthetic oligonucleotide"
uucugcaucuuagccugcu

SEQ ID NO: 741 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucauccucuucacaggguutt

SEQ ID NO: 742 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacccugugaagaggaugatt

SEQ ID NO: 743 - RNA, 19 nt, Artificial Sequence
  source: /note="Description of Artificial Sequence: Synthetic oligonucleotide"
ucauccucuucacaggguu

SEQ ID NO: 744 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccuaucccauccccauatt

SEQ ID NO: 745 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauggggaugggauaggautt

SEQ ID NO: 746 - RNA, 19 nt, Artificial Sequence
  source: /note="Description of Artificial Sequence: Synthetic oligonucleotide"
auccuaucccauccccauc

SEQ ID NO: 747 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugugcauccuaucccautt

SEQ ID NO: 748 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augggauaggaugcacagatt

SEQ ID NO: 749 - RNA, 19 nt, Artificial Sequence
  source: /note="Description of Artificial Sequence: Synthetic oligonucleotide"
ucugugcauccuaucccau

SEQ ID NO: 750 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaaccaugggcuccucutt

SEQ ID NO: 751 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaggagcccaugguuguatt

SEQ ID NO: 752 - RNA, 19 nt, Artificial Sequence
  source: /note="Description of Artificial Sequence: Synthetic oligonucleotide"
uacaaccaugggcuccucu

SEQ ID NO: 753 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugacugaaaggcugcgutt

SEQ ID NO: 754 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgcagccuuucagucaggtt

SEQ ID NO: 755 - RNA, 19 nt, Artificial Sequence
  source: /note="Description of Artificial Sequence: Synthetic oligonucleotide"
ccugacugaaaggcugcgu

SEQ ID NO: 756 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucggcugaggaugacccutt

SEQ ID NO: 757 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggucauccucagccgaatt

SEQ ID NO: 758 - RNA, 19 nt, Artificial Sequence
  source: /note="Description of Artificial Sequence: Synthetic oligonucleotide"
uucggcugaggaugacccu

SEQ ID NO: 759 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccgggauggcagcaagatt

SEQ ID NO: 760 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuugcugccaucccggaatt

SEQ ID NO: 761 - RNA, 19 nt, Artificial Sequence
  source: /note="Description of Artificial Sequence: Synthetic oligonucleotide"
uuccgggauggcagcaagg

SEQ ID NO: 762 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggugauccauggucacuuutt

SEQ ID NO: 763 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagugaccauggaucacctt

SEQ ID NO: 764 - RNA, 19 nt, Artificial Sequence
  source: /note="Description of Artificial Sequence: Synthetic oligonucleotide"
ggugauccauggucacuuu

SEQ ID NO: 765 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucaagugugugccaggatt

SEQ ID NO: 766 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuggcacacacuugacatt

SEQ ID NO: 767 - RNA, 19 nt, Artificial Sequence
  source: /note="Description of Artificial Sequence: Synthetic oligonucleotide"
ugucaagugugugccaggg

SEQ ID NO: 768 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguucuuugucagugcuatt

SEQ ID NO: 769 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcacugacaaagaacaatt

SEQ ID NO: 770 - RNA, 19 nt, Artificial Sequence
  source: /note="Description of Artificial Sequence: Synthetic oligonucleotide"
uuguucuuugucagugcug

SEQ ID NO: 771 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccugcacauguuguucutt

SEQ ID NO: 772 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaacaacaugugcagguatt

SEQ ID NO: 773 - RNA, 19 nt, Artificial Sequence
  source: /note="Description of Artificial Sequence: Synthetic oligonucleotide"
uaccugcacauguuguucu

SEQ ID NO: 774 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugccaccacagguaccutt

SEQ ID NO: 775 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguaccugugguggcagctt

SEQ ID NO: 776 - RNA, 19 nt, Artificial Sequence
  source: /note="Description of Artificial Sequence: Synthetic oligonucleotide"
gcugccaccacagguaccu

SEQ ID NO: 777 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgcagcuugggaggugcutt

SEQ ID NO: 778 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaccucccaagcugcggtt

SEQ ID NO: 779 - RNA, 19 nt, Artificial Sequence
  source: /note="Description of Artificial Sequence: Synthetic oligonucleotide"
ccgcagcuugggaggugcu

SEQ ID NO: 780 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccgccgccgccgccgcaatt

SEQ ID NO: 781 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcggcggcggcggcggctt

SEQ ID NO: 782 - RNA, 19 nt, Artificial Sequence
  source: /note="Description of Artificial Sequence: Synthetic oligonucleotide"
gccgccgccgccgccgcag

SEQ ID NO: 783 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccgcccccgucgccgcatt

SEQ ID NO: 784 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcggcgacgggggcggcatt

SEQ ID NO: 785 - RNA, 19 nt, Artificial Sequence
  source: /note="Description of Artificial Sequence: Synthetic oligonucleotide"
ugccgcccccgucgccgcc

SEQ ID NO: 786 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgcgcuccgccccugcuatt

SEQ ID NO: 787 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcaggggcggagcgcggtt

SEQ ID NO: 788 - RNA, 19 nt, Artificial Sequence
  source: /note="Description of Artificial Sequence: Synthetic oligonucleotide"
ccgcgcuccgccccugcug

SEQ ID NO: 789 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacgccgcgcuccgcccatt

SEQ ID NO: 790 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggcggagcgcggcgugctt

SEQ ID NO: 791 - RNA, 19 nt, Artificial Sequence
  source: /note="Description of Artificial Sequence: Synthetic oligonucleotide"
gcacgccgcgcuccgcccc

SEQ ID NO: 792 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcgccacgcaccggacugatt

SEQ ID NO: 793 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaguccggugcguggcgctt

SEQ ID NO: 794 - RNA, 19 nt, Artificial Sequence
  source: /note="Description of Artificial Sequence: Synthetic oligonucleotide"
gcgccacgcaccggacugc

SEQ ID NO: 795 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggagagagagggagggcatt

SEQ ID NO: 796 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccucccucucucuccutt

SEQ ID NO: 797 - RNA, 19 nt, Artificial Sequence
  source: /note="Description of Artificial Sequence: Synthetic oligonucleotide"
aggagagagagggagggcg

SEQ ID NO: 798 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcgggcacccggcggccaatt

SEQ ID NO: 799 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggccgccgggugcccgctt

SEQ ID NO: 800 - RNA, 19 nt, Artificial Sequence
  source: /note="Description of Artificial Sequence: Synthetic oligonucleotide"
gcgggcacccggcggccag

SEQ ID NO: 801 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucagauggugggaaggcutt

SEQ ID NO: 802 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccuucccaccaucugaatt

SEQ ID NO: 803 - RNA, 19 nt, Artificial Sequence
  source: /note="Description of Artificial Sequence: Synthetic oligonucleotide"
uucagauggugggaaggcu

SEQ ID NO: 804 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggagagcugggaacgacutt

SEQ ID NO: 805 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucguucccagcucuccutt

SEQ ID NO: 806 - RNA, 19 nt, Artificial Sequence
  source: /note="Description of Artificial Sequence: Synthetic oligonucleotide"
aggagagcugggaacgacu

SEQ ID NO: 807 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcgggcuugaggcucaatt

SEQ ID NO: 808 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugagccucaagcccgcugtt

SEQ ID NO: 809 - RNA, 19 nt, Artificial Sequence
  source: /note="Description of Artificial Sequence: Synthetic oligonucleotide"
cagcgggcuugaggcucag

SEQ ID NO: 810 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgggacaguggcgugggcatt

SEQ ID NO: 811 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccacgccacugucccgtt

SEQ ID NO: 812 - RNA, 19 nt, Artificial Sequence
  source: /note="Description of Artificial Sequence: Synthetic oligonucleotide"
cgggacaguggcgugggca

SEQ ID NO: 813 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcgccgggacaguggcgutt

SEQ ID NO: 814 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgccacugucccggcgcutt

SEQ ID NO: 815 - RNA, 19 nt, Artificial Sequence
  source: /note="Description of Artificial Sequence: Synthetic oligonucleotide"
agcgccgggacaguggcgu

SEQ ID NO: 816 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgcgcccaggcaggcagatt

SEQ ID NO: 817 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugccugccugggcgcggtt

SEQ ID NO: 818 - RNA, 19 nt, Artificial Sequence
  source: /note="Description of Artificial Sequence: Synthetic oligonucleotide"
ccgcgcccaggcaggcagc

SEQ ID NO: 819 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugccuaacgcgcauuccatt

SEQ ID NO: 820 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaaugcgcguuaggcaatt

SEQ ID NO: 821 - RNA, 19 nt, Artificial Sequence
  source: /note="Description of Artificial Sequence: Synthetic oligonucleotide"
uugccuaacgcgcauuccg

SEQ ID NO: 822 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacgcgcagaccggggauutt

SEQ ID NO: 823 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauccccggucugcgcguctt

SEQ ID NO: 824 - RNA, 19 nt, Artificial Sequence
  source: /note="Description of Artificial Sequence: Synthetic oligonucleotide"
gacgcgcagaccggggauu

SEQ ID NO: 825 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcgugugggacgcgcatt

SEQ ID NO: 826 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcgcgucccacacgcagatt

SEQ ID NO: 827 - RNA, 19 nt, Artificial Sequence
  source: /note="Description of Artificial Sequence: Synthetic oligonucleotide"
ucugcgugugggacgcgca

SEQ ID NO: 828 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaugcugcuggugagcuatt

SEQ ID NO: 829 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcucaccagcagcaugctt

SEQ ID NO: 830 - RNA, 19 nt, Artificial Sequence
  source: /note="Description of Artificial Sequence: Synthetic oligonucleotide"
gcaugcugcuggugagcug

SEQ ID NO: 831 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccuggccagcgacggcatt

SEQ ID NO: 832 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccgucgcuggccaggcatt

SEQ ID NO: 833 - RNA, 19 nt, Artificial Sequence
  source: /note="Description of Artificial Sequence: Synthetic oligonucleotide"
ugccuggccagcgacggca

SEQ ID NO: 834 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucauggacaucgagugatt

SEQ ID NO: 835 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacucgauguccaugaggtt

SEQ ID NO: 836 - RNA, 19 nt, Artificial Sequence
  source: /note="Description of Artificial Sequence: Synthetic oligonucleotide"
ccucauggacaucgagugc

SEQ ID NO: 837 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugugcugcgcggccaccutt

SEQ ID NO: 838 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguggccgcgcagcacaatt

SEQ ID NO: 839 - RNA, 19 nt, Artificial Sequence
  source: /note="Description of Artificial Sequence: Synthetic oligonucleotide"
uugugcugcgcggccaccu

SEQ ID NO: 840 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacggagaucgugccgcuutt

SEQ ID NO: 841 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcggcacgaucuccguctt

SEQ ID NO: 842 - RNA, 19 nt, Artificial Sequence
  source: /note="Description of Artificial Sequence: Synthetic oligonucleotide"
gacggagaucgugccgcuu

SEQ ID NO: 843 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgagacggagaucgugcatt

SEQ ID NO: 844 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcacgaucuccgucucggtt

SEQ ID NO: 845 - RNA, 19 nt, Artificial Sequence
  source: /note="Description of Artificial Sequence: Synthetic oligonucleotide"
ccgagacggagaucgugcc

SEQ ID NO: 846 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacggcuaugcgccacccatt

SEQ ID NO: 847 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggguggcgcauagccguatt

SEQ ID NO: 848 - RNA, 19 nt, Artificial Sequence
  source: /note="Description of Artificial Sequence: Synthetic oligonucleotide"
uacggcuaugcgccacccg

SEQ ID NO: 849 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccugcgacgacuacgatt

SEQ ID NO: 850 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucguagucgucgcagggcatt

SEQ ID NO: 851 - RNA, 19 nt, Artificial Sequence
  source: /note="Description of Artificial Sequence: Synthetic oligonucleotide"
ugcccugcgacgacuacgg

SEQ ID NO: 852 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggaggcgcggggagcugatt

SEQ ID NO: 853 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcuccccgcgccuccgtt

SEQ ID NO: 854 - RNA, 19 nt, Artificial Sequence
  source: /note="Description of Artificial Sequence: Synthetic oligonucleotide"
cggaggcgcggggagcugc

SEQ ID NO: 855 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcaacuacgggcagcugatt

SEQ ID NO: 856 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcugcccguaguugcgtt

SEQ ID NO: 857 - RNA, 19 nt, Artificial Sequence
  source: /note="Description of Artificial Sequence: Synthetic oligonucleotide"
cgcaacuacgggcagcugg

SEQ ID NO: 858 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuaugcccgcgcaacuaatt

SEQ ID NO: 859 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaguugcgcgggcauagctt

SEQ ID NO: 860 - RNA, 19 nt, Artificial Sequence
  source: /note="Description of Artificial Sequence: Synthetic oligonucleotide"
gcuaugcccgcgcaacuac

SEQ ID NO: 861 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugccucuaccgcgugcutt

SEQ ID NO: 862 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcacgcgguagaggcagatt

SEQ ID NO: 863 - RNA, 19 nt, Artificial Sequence
  source: /note="Description of Artificial Sequence: Synthetic oligonucleotide"
ucugccucuaccgcgugcu

SEQ ID NO: 864 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggccaccggcaucgucuutt

SEQ ID NO: 865 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagacgaugccgguggccatt

SEQ ID NO: 866 - RNA, 19 nt, Artificial Sequence
  source: /note="Description of Artificial Sequence: Synthetic oligonucleotide"
uggccaccggcaucgucuu

SEQ ID NO: 867 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugggccuggccaccggatt

SEQ ID NO: 868 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgguggccaggcccagctt

SEQ ID NO: 869 - RNA, 19 nt, Artificial Sequence
  source: /note="Description of Artificial Sequence: Synthetic oligonucleotide"
gcugggccuggccaccggc

SEQ ID NO: 870 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguacaagguggcggcgcutt

SEQ ID NO: 871 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcgccgccaccuuguacatt

SEQ ID NO: 872 - RNA, 19 nt, Artificial Sequence
  source: /note="Description of Artificial Sequence: Synthetic oligonucleotide"
uguacaagguggcggcgcu

SEQ ID NO: 873 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacgcuguacaagguggatt

SEQ ID NO: 874 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaccuuguacagcgugatt

SEQ ID NO: 875 - RNA, 19 nt, Artificial Sequence
  source: /note="Description of Artificial Sequence: Synthetic oligonucleotide"
ucacgcuguacaagguggc

SEQ ID NO: 876 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggcccauggagacgucatt

SEQ ID NO: 877 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugacgucuccaugggccugtt

SEQ ID NO: 878 - RNA, 19 nt, Artificial Sequence
  source: /note="Description of Artificial Sequence: Synthetic oligonucleotide"
caggcccauggagacguca

SEQ ID NO: 879 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguggggugcaggcccautt

SEQ ID NO: 880 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augggccugcaccccaccutt

SEQ ID NO: 881 - RNA, 19 nt, Artificial Sequence
  source: /note="Description of Artificial Sequence: Synthetic oligonucleotide"
agguggggugcaggcccau

SEQ ID NO: 882 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggacccaagggcccagatt

SEQ ID NO: 883 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugggcccuuggguccugtt

SEQ ID NO: 884 - RNA, 19 nt, Artificial Sequence
  source: /note="Description of Artificial Sequence: Synthetic oligonucleotide"
caggacccaagggcccagg

SEQ ID NO: 885 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcugggcacugggaagcatt

SEQ ID NO: 886 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucccagugcccagcatt

SEQ ID NO: 887 - RNA, 19 nt, Artificial Sequence
  source: /note="Description of Artificial Sequence: Synthetic oligonucleotide"
ugcugggcacugggaagca

SEQ ID NO: 888 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaccggggcccauaccuatt

SEQ ID NO: 889 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagguaugggccccgguggtt

SEQ ID NO: 890 - RNA, 19 nt, Artificial Sequence
  source: /note="Description of Artificial Sequence: Synthetic oligonucleotide"
ccaccggggcccauaccug

SEQ ID NO: 891 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acccucaggacggccgcaatt

SEQ ID NO: 892 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcggccguccugagggutt

SEQ ID NO: 893 - RNA, 19 nt, Artificial Sequence
  source: /note="Description of Artificial Sequence: Synthetic oligonucleotide"
acccucaggacggccgcag

SEQ ID NO: 894 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcucuggagggccggcacatt

SEQ ID NO: 895 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugccggcccuccagagctt

SEQ ID NO: 896 - RNA, 19 nt, Artificial Sequence
  source: /note="Description of Artificial Sequence: Synthetic oligonucleotide"
gcucuggagggccggcacc

SEQ ID NO: 897 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuccgccugaacccgagatt

SEQ ID NO: 898 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucggguucaggcggagctt

SEQ ID NO: 899 - RNA, 19 nt, Artificial Sequence
  source: /note="Description of Artificial Sequence: Synthetic oligonucleotide"
gcuccgccugaacccgagg

SEQ ID NO: 900 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgucaucccagucacgcutt

SEQ ID NO: 901 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcgugacugggaugacggtt

SEQ ID NO: 902 - RNA, 19 nt, Artificial Sequence
  source: /note="Description of Artificial Sequence: Synthetic oligonucleotide"
ccgucaucccagucacgcu

SEQ ID NO: 903 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaucagccugcugcccatt

SEQ ID NO: 904 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggcagcaggcugauguatt

SEQ ID NO: 905 - RNA, 19 nt, Artificial Sequence
  source: /note="Description of Artificial Sequence: Synthetic oligonucleotide"
uacaucagccugcugcccg

SEQ ID NO: 906 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaagagguacaucagccutt

SEQ ID NO: 907 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcugauguaccucuuggtt

SEQ ID NO: 908 - RNA, 19 nt, Artificial Sequence
  source: /note="Description of Artificial Sequence: Synthetic oligonucleotide"
ccaagagguacaucagccu

SEQ ID NO: 909 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaacaucacacuggccatt

SEQ ID NO: 910 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggccagugugauguuguatt

SEQ ID NO: 911 - RNA, 19 nt, Artificial Sequence
  source: /note="Description of Artificial Sequence: Synthetic oligonucleotide"
uacaacaucacacuggcca

SEQ ID NO: 912 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgacgcucuucagcuauuatt

SEQ ID NO: 913 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaauagcugaagagcgucgtt

SEQ ID NO: 914 - RNA, 19 nt, Artificial Sequence
  source: /note="Description of Artificial Sequence: Synthetic oligonucleotide"
cgacgcucuucagcuauua

SEQ ID NO: 915 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgccacuggccgacgcutt

SEQ ID NO: 916 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcgucggccaguggcggatt

SEQ ID NO: 917 - RNA, 19 nt, Artificial Sequence
  source: /note="Description of Artificial Sequence: Synthetic oligonucleotide"
uccgccacuggccgacgcu

SEQ ID NO: 918 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuguccuuccgccacugatt

SEQ ID NO: 919 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaguggcggaaggacaautt

SEQ ID NO: 920 - RNA, 19 nt, Artificial Sequence
  source: /note="Description of Artificial Sequence: Synthetic oligonucleotide"
auuguccuuccgccacugg

SEQ ID NO: 921 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaacuuuggaggaaauutt

SEQ ID NO: 922 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuuccuccaaaguuccutt

SEQ ID NO: 923 - RNA, 19 nt, Artificial Sequence
  source: /note="Description of Artificial Sequence: Synthetic oligonucleotide"
aggaacuuuggaggaaauu

SEQ ID NO: 924 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugggggccugaggaugaatt

SEQ ID NO: 925 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucauccucaggcccccagtt

SEQ ID NO: 926 - RNA, 19 nt, Artificial Sequence
  source: /note="Description of Artificial Sequence: Synthetic oligonucleotide"
cugggggccugaggaugag

SEQ ID NO: 927 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucccagagguaaccugatt

SEQ ID NO: 928 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagguuaccucugggacutt

SEQ ID NO: 929 - RNA, 19 nt, Artificial Sequence
  source: /note="Description of Artificial Sequence: Synthetic oligonucleotide"
agucccagagguaaccugg

SEQ ID NO: 930 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguccaugacagcccagutt

SEQ ID NO: 931 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugggcugucauggacaatt

SEQ ID NO: 932 - RNA, 19 nt, Artificial Sequence
  source: /note="Description of Artificial Sequence: Synthetic oligonucleotide"
uuguccaugacagcccagu

SEQ ID NO: 933 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguccagcagagguuguatt

SEQ ID NO: 934 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaaccucugcuggaccutt

SEQ ID NO: 935 - RNA, 19 nt, Artificial Sequence
  source: /note="Description of Artificial Sequence: Synthetic oligonucleotide"
agguccagcagagguuguc

SEQ ID NO: 936 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucaccugagcguggagatt

SEQ ID NO: 937 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccacgcucaggugacutt

SEQ ID NO: 938 - RNA, 19 nt, Artificial Sequence
  source: /note="Description of Artificial Sequence: Synthetic oligonucleotide"
agucaccugagcguggagg

SEQ ID NO: 939 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagacgucgccaggcgagutt

SEQ ID NO: 940 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgccuggcgacgucugtt

SEQ ID NO: 941 - RNA, 19 nt, Artificial Sequence
  source: /note="Description of Artificial Sequence: Synthetic oligonucleotide"
cagacgucgccaggcgagu

SEQ ID NO: 942 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagcuaccugagaaccaatt

SEQ ID NO: 943 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugguucucagguagcuuatt

SEQ ID NO: 944 - RNA, 19 nt, Artificial Sequence
  source: /note="Description of Artificial Sequence: Synthetic oligonucleotide"
uaagcuaccugagaaccag

SEQ ID NO: 945 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaugccccuaagcuacatt

SEQ ID NO: 946 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguagcuuaggggcaucagtt

SEQ ID NO: 947 - RNA, 19 nt, Artificial Sequence
  source: /note="Description of Artificial Sequence: Synthetic oligonucleotide"
cugaugccccuaagcuacc

SEQ ID NO: 948 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuccaucuucccaccuatt

SEQ ID NO: 949 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggugggaagauggagaatt

SEQ ID NO: 950 - RNA, 19 nt, Artificial Sequence
  source: /note="Description of Artificial Sequence: Synthetic oligonucleotide"
uucuccaucuucccaccug

SEQ ID NO: 951 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccuucuccaucuucccatt

SEQ ID NO: 952 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggaagauggagaaggcatt

SEQ ID NO: 953 - RNA, 19 nt, Artificial Sequence
  source: /note="Description of Artificial Sequence: Synthetic oligonucleotide"
ugccuucuccaucuuccca

SEQ ID NO: 954 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagccacccggacccugatt

SEQ ID NO: 955 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggguccggguggcuggtt

SEQ ID NO: 956 - RNA, 19 nt, Artificial Sequence
  source: /note="Description of Artificial Sequence: Synthetic oligonucleotide"
ccagccacccggacccugc

SEQ ID NO: 957 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccccccagccacccggatt

SEQ ID NO: 958 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccggguggcuggggggcatt

SEQ ID NO: 959 - RNA, 19 nt, Artificial Sequence
  source: /note="Description of Artificial Sequence: Synthetic oligonucleotide"
ugccccccagccacccgga

SEQ ID NO: 960 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugccuaguggcaugcugatt

SEQ ID NO: 961 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcaugccacuaggcactt

SEQ ID NO: 962 - RNA, 19 nt, Artificial Sequence
  source: /note="Description of Artificial Sequence: Synthetic oligonucleotide"
gugccuaguggcaugcugc

SEQ ID NO: 963 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuggcucccaugcccguatt

SEQ ID NO: 964 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacgggcaugggagccaggtt

SEQ ID NO: 965 - RNA, 19 nt, Artificial Sequence
  source: /note="Description of Artificial Sequence: Synthetic oligonucleotide"
ccuggcucccaugcccgug

SEQ ID NO: 966 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauugggugagggagcccutt

SEQ ID NO: 967 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggcucccucacccaaugtt

SEQ ID NO: 968 - RNA, 19 nt, Artificial Sequence
  source: /note="Description of Artificial Sequence: Synthetic oligonucleotide"
cauugggugagggagcccu

SEQ ID NO: 969 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggugacggaacagagcatt

SEQ ID NO: 970 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcucuguuccgucaccugtt

SEQ ID NO: 971 - RNA, 19 nt, Artificial Sequence
  source: /note="Description of Artificial Sequence: Synthetic oligonucleotide"
caggugacggaacagagcc

SEQ ID NO: 972 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugcccaggugacggaaatt

SEQ ID NO: 973 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuccgucaccugggcagctt

SEQ ID NO: 974 - RNA, 19 nt, Artificial Sequence
  source: /note="Description of Artificial Sequence: Synthetic oligonucleotide"
gcugcccaggugacggaac

SEQ ID NO: 975 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugcgcaacuaccucgcutt

SEQ ID NO: 976 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcgagguaguugcgcagctt

SEQ ID NO: 977 - RNA, 19 nt, Artificial Sequence
  source: /note="Description of Artificial Sequence: Synthetic oligonucleotide"
gcugcgcaacuaccucgcu

SEQ ID NO: 978 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacagacccagcagggcutt

SEQ ID NO: 979 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcccugcugggucugugutt

SEQ ID NO: 980 - RNA, 19 nt, Artificial Sequence
  source: /note="Description of Artificial Sequence: Synthetic oligonucleotide"
acacagacccagcagggcu

SEQ ID NO: 981 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugguauacacagacccatt

SEQ ID NO: 982 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggucuguguauaccaggtt

SEQ ID NO: 983 - RNA, 19 nt, Artificial Sequence
  source: /note="Description of Artificial Sequence: Synthetic oligonucleotide"
ccugguauacacagaccca

SEQ ID NO: 984 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugucuggauuggcauccutt

SEQ ID NO: 985 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaugccaauccagacaatt

SEQ ID NO: 986 - RNA, 19 nt, Artificial Sequence
  source: /note="Description of Artificial Sequence: Synthetic oligonucleotide"
uugucuggauuggcauccu

SEQ ID NO: 987 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucauggcuggcaccguutt

SEQ ID NO: 988 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacggugccagccaugaugtt

SEQ ID NO: 989 - RNA, 19 nt, Artificial Sequence
  source: /note="Description of Artificial Sequence: Synthetic oligonucleotide"
caucauggcuggcaccguu

SEQ ID NO: 990 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccuggcacagcgccucautt

SEQ ID NO: 991 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaggcgcugugccaggctt

SEQ ID NO: 992 - RNA, 19 nt, Artificial Sequence
  source: /note="Description of Artificial Sequence: Synthetic oligonucleotide"
gccuggcacagcgccucau

SEQ ID NO: 993 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccuggcccgcacccgcatt

SEQ ID NO: 994 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcgggugcgggccaggaatt

SEQ ID NO: 995 - RNA, 19 nt, Artificial Sequence
  source: /note="Description of Artificial Sequence: Synthetic oligonucleotide"
uuccuggcccgcacccgcc

SEQ ID NO: 996 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcugcguguugucuacuutt

SEQ ID NO: 997 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguagacaacacgcagcctt

SEQ ID NO: 998 - RNA, 19 nt, Artificial Sequence
  source: /note="Description of Artificial Sequence: Synthetic oligonucleotide"
ggcugcguguugucuacuu

SEQ ID NO: 999 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccccaagaggcugcgugutt

SEQ ID NO: 1000 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacgcagccucuuggggatt

SEQ ID NO: 1001 - RNA, 19 nt, Artificial Sequence
  source: /note="Description of Artificial Sequence: Synthetic oligonucleotide"
uccccaagaggcugcgugu

SEQ ID NO: 1002 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccgaaaccugcggcucatt

SEQ ID NO: 1003 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagccgcagguuucggaatt

SEQ ID NO: 1004 - RNA, 19 nt, Artificial Sequence
  source: /note="Description of Artificial Sequence: Synthetic oligonucleotide"
uuccgaaaccugcggcucc

SEQ ID NO: 1005 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cguugcagccgucuuccuutt

SEQ ID NO: 1006 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggaagacggcugcaacgtt

SEQ ID NO: 1007 - RNA, 19 nt, Artificial Sequence
  source: /note="Description of Artificial Sequence: Synthetic oligonucleotide"
cguugcagccgucuuccuu

SEQ ID NO: 1008 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccccacaccaucacguugatt

SEQ ID NO: 1009 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaacgugaugguguggggtt

SEQ ID NO: 1010 - RNA, 19 nt, Artificial Sequence
  source: /note="Description of Artificial Sequence: Synthetic oligonucleotide"
ccccacaccaucacguugc

SEQ ID NO: 1011 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugaggccguccacaccatt

SEQ ID NO: 1012 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguguggacggccucacatt

SEQ ID NO: 1013 - RNA, 19 nt, Artificial Sequence
  source: /note="Description of Artificial Sequence: Synthetic oligonucleotide"
ugugaggccguccacaccc

SEQ ID NO: 1014 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcagcuggcugugaggcatt

SEQ ID NO: 1015 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccucacagccagcugcctt

SEQ ID NO: 1016 - RNA, 19 nt, Artificial Sequence
  source: /note="Description of Artificial Sequence: Synthetic oligonucleotide"
ggcagcuggcugugaggcc

SEQ ID NO: 1017 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaacgcgcuacgagcggatt

SEQ ID NO: 1018 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgcucguagcgcguuggtt

SEQ ID NO: 1019 - RNA, 19 nt, Artificial Sequence
  source: /note="Description of Artificial Sequence: Synthetic oligonucleotide"
ccaacgcgcuacgagcggc

SEQ ID NO: 1020 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caagccagugggacagccatt

SEQ ID NO: 1021 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcugucccacuggcuugtt

SEQ ID NO: 1022 - RNA, 19 nt, Artificial Sequence
  source: /note="Description of Artificial Sequence: Synthetic oligonucleotide"
caagccagugggacagcca

SEQ ID NO: 1023 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccugccugcccucagccatt

SEQ ID NO: 1024 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcugagggcaggcaggctt

SEQ ID NO: 1025 - RNA, 19 nt, Artificial Sequence
  source: /note="Description of Artificial Sequence: Synthetic oligonucleotide"
gccugccugcccucagcca

SEQ ID NO: 1026 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcgacugcccccugaggcatt

SEQ ID NO: 1027 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccucagggggcagucgctt

SEQ ID NO: 1028 - RNA, 19 nt, Artificial Sequence
  source: /note="Description of Artificial Sequence: Synthetic oligonucleotide"
gcgacugcccccugaggcc

SEQ ID NO: 1029 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcagaccugaacaagcatt

SEQ ID NO: 1030 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuuguucaggucugcuatt

SEQ ID NO: 1031 - RNA, 19 nt, Artificial Sequence
  source: /note="Description of Artificial Sequence: Synthetic oligonucleotide"
uagcagaccugaacaagcg

SEQ ID NO: 1032 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauucgccggauggagcuatt

SEQ ID NO: 1033 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcuccauccggcgaaugtt

SEQ ID NO: 1034 - RNA, 19 nt, Artificial Sequence
  source: /note="Description of Artificial Sequence: Synthetic oligonucleotide"
cauucgccggauggagcua

SEQ ID NO: 1035 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuguccuguccauugacatt

SEQ ID NO: 1036 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucaauggacaggacagutt

SEQ ID NO: 1037 - RNA, 19 nt, Artificial Sequence
  source: /note="Description of Artificial Sequence: Synthetic oligonucleotide"
acuguccuguccauugaca

SEQ ID NO: 1038 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaccacuguccuguccatt

SEQ ID NO: 1039 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacaggacaguggugaatt

SEQ ID NO: 1040 - RNA, 19 nt, Artificial Sequence
  source: /note="Description of Artificial Sequence: Synthetic oligonucleotide"
uucaccacuguccugucca

SEQ ID NO: 1041 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuuuucaccacuguccutt

SEQ ID NO: 1042 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggacaguggugaaaaacatt

SEQ ID NO: 1043 - RNA, 19 nt, Artificial Sequence
  source: /note="Description of Artificial Sequence: Synthetic oligonucleotide"
uguuuuucaccacuguccu

SEQ ID NO: 1044 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuuccuucagaugcugutt

SEQ ID NO: 1045 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagcaucugaaggaagaatt

SEQ ID NO: 1046 - RNA, 19 nt, Artificial Sequence
  source: /note="Description of Artificial Sequence: Synthetic oligonucleotide"
uucuuccuucagaugcugu

SEQ ID NO: 1047 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggugucugacuucuuccutt

SEQ ID NO: 1048 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaagaagucagacaccatt

SEQ ID NO: 1049 - RNA, 19 nt, Artificial Sequence
  source: /note="Description of Artificial Sequence: Synthetic oligonucleotide"
uggugucugacuucuuccu

SEQ ID NO: 1050 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugcugucguggggcugatt

SEQ ID NO: 1051 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagccccacgacagcaaatt

SEQ ID NO: 1052 - RNA, 19 nt, Artificial Sequence
  source: /note="Description of Artificial Sequence: Synthetic oligonucleotide"
uuugcugucguggggcugg

SEQ ID NO: 1053 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucuuugcugucgugggatt

SEQ ID NO: 1054 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccacgacagcaaagagatt

SEQ ID NO: 1055 - RNA, 19 nt, Artificial Sequence
  source: /note="Description of Artificial Sequence: Synthetic oligonucleotide"
ucucuuugcugucgugggg

SEQ ID NO: 1056 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccauccaggaguucugucutt

SEQ ID NO: 1057 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacagaacuccuggauggtt

SEQ ID NO: 1058 - RNA, 19 nt, Artificial Sequence
  source: /note="Description of Artificial Sequence: Synthetic oligonucleotide"
ccauccaggaguucugucu

SEQ ID NO: 1059 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucacccuagugcccgccatt

SEQ ID NO: 1060 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcgggcacuagggugaatt

SEQ ID NO: 1061 - RNA, 19 nt, Artificial Sequence
  source: /note="Description of Artificial Sequence: Synthetic oligonucleotide"
uucacccuagugcccgcca

SEQ ID NO: 1062 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucauccucaucggcuacuutt

SEQ ID NO: 1063 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguagccgaugaggaugatt

SEQ ID NO: 1064 - RNA, 19 nt, Artificial Sequence
  source: /note="Description of Artificial Sequence: Synthetic oligonucleotide"
ucauccucaucggcuacuu

SEQ ID NO: 1065 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccacggagcugggcaucatt

SEQ ID NO: 1066 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaugcccagcuccguggctt

SEQ ID NO: 1067 - RNA, 19 nt, Artificial Sequence
  source: /note="Description of Artificial Sequence: Synthetic oligonucleotide"
gccacggagcugggcauca

SEQ ID NO: 1068 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucaugaagaacauggcatt

SEQ ID NO: 1069 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccauguucuucaugaugtt

SEQ ID NO: 1070 - RNA, 19 nt, Artificial Sequence
  source: /note="Description of Artificial Sequence: Synthetic oligonucleotide"
caucaugaagaacauggcc

SEQ ID NO: 1071 - RNA, 19 nt, Artificial Sequence
  source: /note="Description of Artificial Sequence: Synthetic oligonucleotide"
gcgggcacccggcggccaa

SEQ ID NO: 1072 - RNA, 19 nt, Artificial Sequence
  source: /note="Description of Artificial Sequence: Synthetic oligonucleotide"
uuggccgccgggugcccgc

SEQ ID NO: 1073 - RNA, 19 nt, Artificial Sequence
  source: /note="Description of Artificial Sequence: Synthetic oligonucleotide"
aggagagagagggagggca

SEQ ID NO: 1074 - RNA, 19 nt, Artificial Sequence
  source: /note="Description of Artificial Sequence: Synthetic oligonucleotide"
ugcccucccucucucuccu

SEQ ID NO: 1075 - RNA, 19 nt, Artificial Sequence
  source: /note="Description of Artificial Sequence: Synthetic oligonucleotide"
gcgccacgcaccggacuga

SEQ ID NO: 1076 - RNA, 19 nt, Artificial Sequence
  source: /note="Description of Artificial Sequence: Synthetic oligonucleotide"
ucaguccggugcguggcgc

SEQ ID NO: 1077 - RNA, 19 nt, Artificial Sequence
  source: /note="Description of Artificial Sequence: Synthetic oligonucleotide"
gcacgccgcgcuccgccca

SEQ ID NO: 1078 - RNA, 19 nt, Artificial Sequence
  source: /note="Description of Artificial Sequence: Synthetic oligonucleotide"
ugggcggagcgcggcgugc

SEQ ID NO: 1079 - RNA, 19 nt, Artificial Sequence
  source: /note="Description of Artificial Sequence: Synthetic oligonucleotide"
ccgcgcuccgccccugcua

SEQ ID NO: 1080 - RNA, 19 nt, Artificial Sequence
  source: /note="Description of Artificial Sequence: Synthetic oligonucleotide"
uagcaggggcggagcgcgg

SEQ ID NO: 1081 - RNA, 19 nt, Artificial Sequence
  source: /note="Description of Artificial Sequence: Synthetic oligonucleotide"
ugccgcccccgucgccgca

SEQ ID NO: 1082 - RNA, 19 nt, Artificial Sequence
  source: /note="Description of Artificial Sequence: Synthetic oligonucleotide"
ugcggcgacgggggcggca

SEQ ID NO: 1083 - RNA, 19 nt, Artificial Sequence
  source: /note="Description of Artificial Sequence: Synthetic oligonucleotide"
gccgccgccgccgccgcaa

SEQ ID NO: 1084 - RNA, 19 nt, Artificial Sequence
  source: /note="Description of Artificial Sequence: Synthetic oligonucleotide"
uugcggcggcggcggcggc

SEQ ID NO: 1085 - RNA, 19 nt, Artificial Sequence
  source: /note="Description of Artificial Sequence: Synthetic oligonucleotide"
ccgcagcuugggaggugcu

SEQ ID NO: 1086 - RNA, 19 nt, Artificial Sequence
  source: /note="Description of Artificial Sequence: Synthetic oligonucleotide"
agcaccucccaagcugcgg

SEQ ID NO: 1087 - RNA, 19 nt, Artificial Sequence
  source: /note="Description of Artificial Sequence: Synthetic oligonucleotide"
gcugccaccacagguaccu

SEQ ID NO: 1088 - RNA, 19 nt, Artificial Sequence
  source: /note="Description of Artificial Sequence: Synthetic oligonucleotide"
agguaccugugguggcagc

SEQ ID NO: 1089 - RNA, 19 nt, Artificial Sequence
  source: /note="Description of Artificial Sequence: Synthetic oligonucleotide"
uaccugcacauguuguucu

SEQ ID NO: 1090 - RNA, 19 nt, Artificial Sequence
  source: /note="Description of Artificial Sequence: Synthetic oligonucleotide"
agaacaacaugugcaggua

SEQ ID NO: 1091 - RNA, 19 nt, Artificial Sequence
  source: /note="Description of Artificial Sequence: Synthetic oligonucleotide"
uuguucuuugucagugcua

SEQ ID NO: 1092 - RNA, 19 nt, Artificial Sequence
  source: /note="Description of Artificial Sequence: Synthetic oligonucleotide"
uagcacugacaaagaacaa

SEQ ID NO: 1093 - RNA, 19 nt, Artificial Sequence
  source: /note="Description of Artificial Sequence: Synthetic oligonucleotide"
ugucaagugugugccagga

SEQ ID NO: 1094 - RNA, 19 nt, Artificial Sequence
  source: /note="Description of Artificial Sequence: Synthetic oligonucleotide"
uccuggcacacacuugaca

SEQ ID NO: 1095 - RNA, 19 nt, Artificial Sequence
  source: /note="Description of Artificial Sequence: Synthetic oligonucleotide"
ggugauccauggucacuuu

SEQ ID NO: 1096 - RNA, 19 nt, Artificial Sequence
  source: /note="Description of Artificial Sequence: Synthetic oligonucleotide"
aaagugaccauggaucacc

SEQ ID NO: 1097 - RNA, 19 nt, Artificial Sequence
  source: /note="Description of Artificial Sequence: Synthetic oligonucleotide"
uuccgggauggcagcaaga

SEQ ID NO: 1098 - RNA, 19 nt, Artificial Sequence
  source: /note="Description of Artificial Sequence: Synthetic oligonucleotide"
ucuugcugccaucccggaa

SEQ ID NO: 1099 - RNA, 19 nt, Artificial Sequence
  source: /note="Description of Artificial Sequence: Synthetic oligonucleotide"
uucggcugaggaugacccu

SEQ ID NO: 1100 - RNA, 19 nt, Artificial Sequence
  source: /note="Description of Artificial Sequence: Synthetic oligonucleotide"
agggucauccucagccgaa

SEQ ID NO: 1101 - RNA, 19 nt, Artificial Sequence
  source: /note="Description of Artificial Sequence: Synthetic oligonucleotide"
ccugacugaaaggcugcgu

SEQ ID NO: 1102 - RNA, 19 nt, Artificial Sequence
  source: /note="Description of Artificial Sequence: Synthetic oligonucleotide"
acgcagccuuucagucagg

SEQ ID NO: 1103 - RNA, 19 nt, Artificial Sequence
  source: /note="Description of Artificial Sequence: Synthetic oligonucleotide"
uacaaccaugggcuccucu

SEQ ID NO: 1104 - RNA, 19 nt, Artificial Sequence
  source: /note="Description of Artificial Sequence: Synthetic oligonucleotide"
agaggagcccaugguugua

SEQ ID NO: 1105 - RNA, 19 nt, Artificial Sequence
  source: /note="Description of Artificial Sequence: Synthetic oligonucleotide"
ucugugcauccuaucccau

SEQ ID NO: 1106 - RNA, 19 nt, Artificial Sequence
  source: /note="Description of Artificial Sequence: Synthetic oligonucleotide"
augggauaggaugcacaga

SEQ ID NO: 1107 - RNA, 19 nt, Artificial Sequence
  source: /note="Description of Artificial Sequence: Synthetic oligonucleotide"
auccuaucccauccccaua

SEQ ID NO: 1108 - RNA, 19 nt, Artificial Sequence
  source: /note="Description of Artificial Sequence: Synthetic oligonucleotide"
uauggggaugggauaggau

SEQ ID NO: 1109 - RNA, 19 nt, Artificial Sequence
  source: /note="Description of Artificial Sequence: Synthetic oligonucleotide"
ucauccucuucacaggguu

SEQ ID NO: 1110 - RNA, 19 nt, Artificial Sequence
  source: /note="Description of Artificial Sequence: Synthetic oligonucleotide"
aacccugugaagaggauga

SEQ ID NO: 1111 - RNA, 19 nt, Artificial Sequence
  source: /note="Description of Artificial Sequence: Synthetic oligonucleotide"
uucugcaucuuagccugcu

SEQ ID NO: 1112 - RNA, 19 nt, Artificial Sequence
  source: /note="Description of Artificial Sequence: Synthetic oligonucleotide"
agcaggcuaagaugcagaa

SEQ ID NO: 1113 - RNA, 19 nt, Artificial Sequence
  source: /note="Description of Artificial Sequence: Synthetic oligonucleotide"
gcugcuacccacugcugaa

SEQ ID NO: 1114 - RNA, 19 nt, Artificial Sequence
  source: /note="Description of Artificial Sequence: Synthetic oligonucleotide"
uucagcaguggguagcagc

SEQ ID NO: 1115 - RNA, 19 nt, Artificial Sequence
  source: /note="Description of Artificial Sequence: Synthetic oligonucleotide"
uacccacugcugaaacuca

SEQ ID NO: 1116 - RNA, 19 nt, Artificial Sequence
  source: /note="Description of Artificial Sequence: Synthetic oligonucleotide"
ugaguuucagcagugggua

SEQ ID NO: 1117 - RNA, 19 nt, Artificial Sequence
  source: /note="Description of Artificial Sequence: Synthetic oligonucleotide"
ccuugccaggaacaggaca

SEQ ID NO: 1118 - RNA, 19 nt, Artificial Sequence
  source: /note="Description of Artificial Sequence: Synthetic oligonucleotide"
uguccuguuccuggcaagg

SEQ ID NO: 1119 - RNA, 19 nt, Artificial Sequence
  source: /note="Description of Artificial Sequence: Synthetic oligonucleotide"
uguggaauucaccaccccu

SEQ ID NO: 1120 - RNA, 19 nt, Artificial Sequence
  source: /note="Description of Artificial Sequence: Synthetic oligonucleotide"
agggguggugaauuccaca

SEQ ID NO: 1121 - RNA, 19 nt, Artificial Sequence
  source: /note="Description of Artificial Sequence: Synthetic oligonucleotide"
ccugugaaggauuacucga

SEQ ID NO: 1122 - RNA, 19 nt, Artificial Sequence
  source: /note="Description of Artificial Sequence: Synthetic oligonucleotide"
ucgaguaauccuucacagg

SEQ ID NO: 1123 - RNA, 19 nt, Artificial Sequence
  source: /note="Description of Artificial Sequence: Synthetic oligonucleotide"
uuacucgcccccaccugua

SEQ ID NO: 1124 - RNA, 19 nt, Artificial Sequence
  source: /note="Description of Artificial Sequence: Synthetic oligonucleotide"
uacaggugggggcgaguaa

SEQ ID NO: 1125 - RNA, 19 nt, Artificial Sequence
  source: /note="Description of Artificial Sequence: Synthetic oligonucleotide"
ccaccuguggacucugaca

SEQ ID NO: 1126 - RNA, 19 nt, Artificial Sequence
  source: /note="Description of Artificial Sequence: Synthetic oligonucleotide"
ugucagaguccacaggugg

SEQ ID NO: 1127 - RNA, 19 nt, Artificial Sequence
  source: /note="Description of Artificial Sequence: Synthetic oligonucleotide"
ccuacugagcagccugagu

SEQ ID NO: 1128 - RNA, 19 nt, Artificial Sequence
  source: /note="Description of Artificial Sequence: Synthetic oligonucleotide"
acucaggcugcucaguagg

SEQ ID NO: 1129 - RNA, 19 nt, Artificial Sequence
  source: /note="Description of Artificial Sequence: Synthetic oligonucleotide"
agugguaugugggugccca

SEQ ID NO: 1130 - RNA, 19 nt, Artificial Sequence
  source: /note="Description of Artificial Sequence: Synthetic oligonucleotide"
ugggcacccacauaccacu

SEQ ID NO: 1131 - RNA, 19 nt, Artificial Sequence
  source: /note="Description of Artificial Sequence: Synthetic oligonucleotide"
cccgguggcuuauguccaa

SEQ ID NO: 1132 - RNA, 19 nt, Artificial Sequence
  source: /note="Description of Artificial Sequence: Synthetic oligonucleotide"
uuggacauaagccaccggg

SEQ ID NO: 1133 - RNA, 19 nt, Artificial Sequence
  source: /note="Description of Artificial Sequence: Synthetic oligonucleotide"
uuauguccagcagauauuu

SEQ ID NO: 1134 - RNA, 19 nt, Artificial Sequence
  source: /note="Description of Artificial Sequence: Synthetic oligonucleotide"
aaauaucugcuggacauaa

SEQ ID NO: 1135 - RNA, 19 nt, Artificial Sequence
  source: /note="Description of Artificial Sequence: Synthetic oligonucleotide"
ugugaaguccucaguguuu

SEQ ID NO: 1136 - RNA, 19 nt, Artificial Sequence
  source: /note="Description of Artificial Sequence: Synthetic oligonucleotide"
aaacacugaggacuucaca

SEQ ID NO: 1137 - RNA, 19 nt, Artificial Sequence
  source: /note="Description of Artificial Sequence: Synthetic oligonucleotide"
uucccuggcacaagaaccu

SEQ ID NO: 1138 - RNA, 19 nt, Artificial Sequence
  source: /note="Description of Artificial Sequence: Synthetic oligonucleotide"
agguucuugugccagggaa

SEQ ID NO: 1139 - RNA, 19 nt, Artificial Sequence
  source: /note="Description of Artificial Sequence: Synthetic oligonucleotide"
ccuccuggcaguagaugua

SEQ ID NO: 1140 - RNA, 19 nt, Artificial Sequence
  source: /note="Description of Artificial Sequence: Synthetic oligonucleotide"
uacaucuacugccaggagg

SEQ ID NO: 1141 - RNA, 19 nt, Artificial Sequence
  source: /note="Description of Artificial Sequence: Synthetic oligonucleotide"
guauuucguucaccuuugu

SEQ ID NO: 1142 - RNA, 19 nt, Artificial Sequence
  source: /note="Description of Artificial Sequence: Synthetic oligonucleotide"
acaaaggugaacgaaauac

SEQ ID NO: 1143 - RNA, 19 nt, Artificial Sequence
  source: /note="Description of Artificial Sequence: Synthetic oligonucleotide"
ucguucaccuuugucccga

SEQ ID NO: 1144 - RNA, 19 nt, Artificial Sequence
  source: /note="Description of Artificial Sequence: Synthetic oligonucleotide"
ucgggacaaaggugaacga

SEQ ID NO: 1145 - RNA, 19 nt, Artificial Sequence
  source: /note="Description of Artificial Sequence: Synthetic oligonucleotide"
gggcauuccaacuggugga

SEQ ID NO: 1146 - RNA, 19 nt, Artificial Sequence
  source: /note="Description of Artificial Sequence: Synthetic oligonucleotide"
uccaccaguuggaaugccc

SEQ ID NO: 1147 - RNA, 19 nt, Artificial Sequence
  source: /note="Description of Artificial Sequence: Synthetic oligonucleotide"
gaggagauccggaaccaca

SEQ ID NO: 1148 - RNA, 19 nt, Artificial Sequence
  source: /note="Description of Artificial Sequence: Synthetic oligonucleotide"
ugugguuccggaucuccuc

SEQ ID NO: 1149 - RNA, 19 nt, Artificial Sequence
  source: /note="Description of Artificial Sequence: Synthetic oligonucleotide"
cgugcugagagacagcucu

SEQ ID NO: 1150 - RNA, 19 nt, Artificial Sequence
  source: /note="Description of Artificial Sequence: Synthetic oligonucleotide"
agagcugucucucagcacg

SEQ ID NO: 1151 - RNA, 19 nt, Artificial Sequence
  source: /note="Description of Artificial Sequence: Synthetic oligonucleotide"
gagacagcucugggaucaa

SEQ ID NO: 1152 - RNA, 19 nt, Artificial Sequence
  source: /note="Description of Artificial Sequence: Synthetic oligonucleotide"
uugaucccagagcugucuc

SEQ ID NO: 1153 - RNA, 19 nt, Artificial Sequence
  source: /note="Description of Artificial Sequence: Synthetic oligonucleotide"
aggagcuuggaggaguugu

SEQ ID NO: 1154 - RNA, 19 nt, Artificial Sequence
  source: /note="Description of Artificial Sequence: Synthetic oligonucleotide"
acaacuccuccaagcuccu

SEQ ID NO: 1155 - RNA, 19 nt, Artificial Sequence
  source: /note="Description of Artificial Sequence: Synthetic oligonucleotide"
ugugucugcaagugaccga

SEQ ID NO: 1156 - RNA, 19 nt, Artificial Sequence
  source: /note="Description of Artificial Sequence: Synthetic oligonucleotide"
ucggucacuugcagacaca

SEQ ID NO: 1157 - RNA, 19 nt, Artificial Sequence
  source: /note="Description of Artificial Sequence: Synthetic oligonucleotide"
cgaccugcugccaggccuu

SEQ ID NO: 1158 - RNA, 19 nt, Artificial Sequence
  source: /note="Description of Artificial Sequence: Synthetic oligonucleotide"
aaggccuggcagcaggucg

SEQ ID NO: 1159 - RNA, 19 nt, Artificial Sequence
  source: /note="Description of Artificial Sequence: Synthetic oligonucleotide"
uuaggaagcucaggaaccu

SEQ ID NO: 1160 - RNA, 19 nt, Artificial Sequence
  source: /note="Description of Artificial Sequence: Synthetic oligonucleotide"
agguuccugagcuuccuaa

SEQ ID NO: 1161 - RNA, 19 nt, Artificial Sequence
  source: /note="Description of Artificial Sequence: Synthetic oligonucleotide"
ccuacucccugagcaugga

SEQ ID NO: 1162 - RNA, 19 nt, Artificial Sequence
  source: /note="Description of Artificial Sequence: Synthetic oligonucleotide"
uccaugcucagggaguagg

SEQ ID NO: 1163 - RNA, 19 nt, Artificial Sequence
  source: /note="Description of Artificial Sequence: Synthetic oligonucleotide"
ucccugagcauggaugccu

SEQ ID NO: 1164 - RNA, 19 nt, Artificial Sequence
  source: /note="Description of Artificial Sequence: Synthetic oligonucleotide"
aggcauccaugcucaggga

SEQ ID NO: 1165 - RNA, 19 nt, Artificial Sequence
  source: /note="Description of Artificial Sequence: Synthetic oligonucleotide"
ccugcugcuguccccugga

SEQ ID NO: 1166 - RNA, 19 nt, Artificial Sequence
  source: /note="Description of Artificial Sequence: Synthetic oligonucleotide"
uccaggggacagcagcagg

SEQ ID NO: 1167 - RNA, 19 nt, Artificial Sequence
  source: /note="Description of Artificial Sequence: Synthetic oligonucleotide"
cuguccccugggaacuucu

SEQ ID NO: 1168 - RNA, 19 nt, Artificial Sequence
  source: /note="Description of Artificial Sequence: Synthetic oligonucleotide"
agaaguucccaggggacag

SEQ ID NO: 1169 - RNA, 19 nt, Artificial Sequence
  source: /note="Description of Artificial Sequence: Synthetic oligonucleotide"
ucuggcagaaugacuggga

SEQ ID NO: 1170 - RNA, 19 nt, Artificial Sequence
  source: /note="Description of Artificial Sequence: Synthetic oligonucleotide"
ucccagucauucugccaga

SEQ ID NO: 1171 - RNA, 19 nt, Artificial Sequence
  source: /note="Description of Artificial Sequence: Synthetic oligonucleotide"
agaaugacugggaacgcuu

SEQ ID NO: 1172 - RNA, 19 nt, Artificial Sequence
  source: /note="Description of Artificial Sequence: Synthetic oligonucleotide"
aagcguucccagucauucu

SEQ ID NO: 1173 - RNA, 19 nt, Artificial Sequence
  source: /note="Description of Artificial Sequence: Synthetic oligonucleotide"
cuuccaugcugauccugaa

SEQ ID NO: 1174 - RNA, 19 nt, Artificial Sequence
  source: /note="Description of Artificial Sequence: Synthetic oligonucleotide"
uucaggaucagcauggaag

SEQ ID NO: 1175 - RNA, 19 nt, Artificial Sequence
  source: /note="Description of Artificial Sequence: Synthetic oligonucleotide"
gacaucauugggaccauca

SEQ ID NO: 1176 - RNA, 19 nt, Artificial Sequence
  source: /note="Description of Artificial Sequence: Synthetic oligonucleotide"
ugauggucccaaugauguc

SEQ ID NO: 1177 - RNA, 19 nt, Artificial Sequence
  source: /note="Description of Artificial Sequence: Synthetic oligonucleotide"
uccaccagcacgagccuaa

SEQ ID NO: 1178 - RNA, 19 nt, Artificial Sequence
  source: /note="Description of Artificial Sequence: Synthetic oligonucleotide"
uuaggcucgugcuggugga

SEQ ID NO: 1179 - RNA, 19 nt, Artificial Sequence
  source: /note="Description of Artificial Sequence: Synthetic oligonucleotide"
cacgagccuaaaacccuga

SEQ ID NO: 1180 - RNA, 19 nt, Artificial Sequence
  source: /note="Description of Artificial Sequence: Synthetic oligonucleotide"
ucaggguuuuaggcucgug

SEQ ID NO: 1181 - RNA, 19 nt, Artificial Sequence
  source: /note="Description of Artificial Sequence: Synthetic oligonucleotide"
ugcagacuucagccacacu

SEQ ID NO: 1182 - RNA, 19 nt, Artificial Sequence
  source: /note="Description of Artificial Sequence: Synthetic oligonucleotide"
aguguggcugaagucugca

SEQ ID NO: 1183 - RNA, 19 nt, Artificial Sequence
  source: /note="Description of Artificial Sequence: Synthetic oligonucleotide"
ucagccacacucaaagacu

SEQ ID NO: 1184 - RNA, 19 nt, Artificial Sequence
  source: /note="Description of Artificial Sequence: Synthetic oligonucleotide"
agucuuugaguguggcuga

SEQ ID NO: 1185 - RNA, 19 nt, Artificial Sequence
  source: /note="Description of Artificial Sequence: Synthetic oligonucleotide"
acuuguuauuugguguuca

SEQ ID NO: 1186 - RNA, 19 nt, Artificial Sequence
  source: /note="Description of Artificial Sequence: Synthetic oligonucleotide"
ugaacaccaaauaacaagu

SEQ ID NO: 1187 - RNA, 19 nt, Artificial Sequence
  source: /note="Description of Artificial Sequence: Synthetic oligonucleotide"
uacagcggggugagccucu

SEQ ID NO: 1188 - RNA, 19 nt, Artificial Sequence
  source: /note="Description of Artificial Sequence: Synthetic oligonucleotide"
agaggcucaccccgcugua

SEQ ID NO: 1189 - RNA, 19 nt, Artificial Sequence
  source: /note="Description of Artificial Sequence: Synthetic oligonucleotide"
ucuacaccaggaagaggau

SEQ ID NO: 1190 - RNA, 19 nt, Artificial Sequence
  source: /note="Description of Artificial Sequence: Synthetic oligonucleotide"
auccucuuccugguguaga

SEQ ID NO: 1191 - RNA, 19 nt, Artificial Sequence
  source: /note="Description of Artificial Sequence: Synthetic oligonucleotide"
ggaagaggauggucuccua

SEQ ID NO: 1192 - RNA, 19 nt, Artificial Sequence
  source: /note="Description of Artificial Sequence: Synthetic oligonucleotide"
uaggagaccauccucuucc

SEQ ID NO: 1193 - RNA, 19 nt, Artificial Sequence
  source: /note="Description of Artificial Sequence: Synthetic oligonucleotide"
uacaccaucacccuggucu

SEQ ID NO: 1194 - RNA, 19 nt, Artificial Sequence
  source: /note="Description of Artificial Sequence: Synthetic oligonucleotide"
agaccagggugauggugua

SEQ ID NO: 1195 - RNA, 19 nt, Artificial Sequence
  source: /note="Description of Artificial Sequence: Synthetic oligonucleotide"
ucuuccagcacuaccauga

SEQ ID NO: 1196 - RNA, 19 nt, Artificial Sequence
  source: /note="Description of Artificial Sequence: Synthetic oligonucleotide"
ucaugguagugcuggaaga

SEQ ID NO: 1197 - RNA, 19 nt, Artificial Sequence
  source: /note="Description of Artificial Sequence: Synthetic oligonucleotide"
ugccaaguuccugggcaga

SEQ ID NO: 1198 - RNA, 19 nt, Artificial Sequence
  source: /note="Description of Artificial Sequence: Synthetic oligonucleotide"
ucugcccaggaacuuggca

SEQ ID NO: 1199 - RNA, 19 nt, Artificial Sequence
  source: /note="Description of Artificial Sequence: Synthetic oligonucleotide"
uuccugggcagccugcgua

SEQ ID NO: 1200 - RNA, 19 nt, Artificial Sequence
  source: /note="Description of Artificial Sequence: Synthetic oligonucleotide"
uacgcaggcugcccaggaa

SEQ ID NO: 1201 - RNA, 19 nt, Artificial Sequence
  source: /note="Description of Artificial Sequence: Synthetic oligonucleotide"
gugcccgccugaugcuucu

SEQ ID NO: 1202 - RNA, 19 nt, Artificial Sequence
  source: /note="Description of Artificial Sequence: Synthetic oligonucleotide"
agaagcaucaggcgggcac

SEQ ID NO: 1203 - RNA, 19 nt, Artificial Sequence
  source: /note="Description of Artificial Sequence: Synthetic oligonucleotide"
uucugcaccccagccccaa

SEQ ID NO: 1204 - RNA, 19 nt, Artificial Sequence
  source: /note="Description of Artificial Sequence: Synthetic oligonucleotide"
uuggggcuggggugcagaa

SEQ ID NO: 1205 - RNA, 19 nt, Artificial Sequence
  source: /note="Description of Artificial Sequence: Synthetic oligonucleotide"
acugcagccuucgggcgga

SEQ ID NO: 1206 - RNA, 19 nt, Artificial Sequence
  source: /note="Description of Artificial Sequence: Synthetic oligonucleotide"
uccgcccgaaggcugcagu

SEQ ID NO: 1207 - RNA, 19 nt, Artificial Sequence
  source: /note="Description of Artificial Sequence: Synthetic oligonucleotide"
gagagccugguccacguga

SEQ ID NO: 1208 - RNA, 19 nt, Artificial Sequence
  source: /note="Description of Artificial Sequence: Synthetic oligonucleotide"
ucacguggaccaggcucuc

SEQ ID NO: 1209 - RNA, 19 nt, Artificial Sequence
  source: /note="Description of Artificial Sequence: Synthetic oligonucleotide"
gcacuucaaggaggagauu

SEQ ID NO: 1210 - RNA, 19 nt, Artificial Sequence
  source: /note="Description of Artificial Sequence: Synthetic oligonucleotide"
aaucuccuccuugaagugc

SEQ ID NO: 1211 - RNA, 19 nt, Artificial Sequence
  source: /note="Description of Artificial Sequence: Synthetic oligonucleotide"
uuggugucgcugagcucau

SEQ ID NO: 1212 - RNA, 19 nt, Artificial Sequence
  source: /note="Description of Artificial Sequence: Synthetic oligonucleotide"
augagcucagcgacaccaa

SEQ ID NO: 1213 - RNA, 19 nt, Artificial Sequence
  source: /note="Description of Artificial Sequence: Synthetic oligonucleotide"
caucccccuugugaccaca

SEQ ID NO: 1214 - RNA, 19 nt, Artificial Sequence
  source: /note="Description of Artificial Sequence: Synthetic oligonucleotide"
uguggucacaagggggaug

SEQ ID NO: 1215 - RNA, 19 nt, Artificial Sequence
  source: /note="Description of Artificial Sequence: Synthetic oligonucleotide"
gaccaccuacaucaucuua

SEQ ID NO: 1216 - RNA, 19 nt, Artificial Sequence
  source: /note="Description of Artificial Sequence: Synthetic oligonucleotide"
uaagaugauguaggugguc

SEQ ID NO: 1217 - RNA, 19 nt, Artificial Sequence
  source: /note="Description of Artificial Sequence: Synthetic oligonucleotide"
uguuugccuacaucuacuu

SEQ ID NO: 1218 - RNA, 19 nt, Artificial Sequence
  source: /note="Description of Artificial Sequence: Synthetic oligonucleotide"
aaguagauguaggcaaaca

SEQ ID NO: 1219 - RNA, 19 nt, Artificial Sequence
  source: /note="Description of Artificial Sequence: Synthetic oligonucleotide"
uucuccacgcggaagauca

SEQ ID NO: 1220 - RNA, 19 nt, Artificial Sequence
  source: /note="Description of Artificial Sequence: Synthetic oligonucleotide"
ugaucuuccgcguggagaa

SEQ ID NO: 1221 - RNA, 19 nt, Artificial Sequence
  source: /note="Description of Artificial Sequence: Synthetic oligonucleotide"
ucgacauggucaaguccaa

SEQ ID NO: 1222 - RNA, 19 nt, Artificial Sequence
  source: /note="Description of Artificial Sequence: Synthetic oligonucleotide"
uuggacuugaccaugucga

SEQ ID NO: 1223 - RNA, 19 nt, Artificial Sequence
  source: /note="Description of Artificial Sequence: Synthetic oligonucleotide"
caagugggggcuggcccua

SEQ ID NO: 1224 - RNA, 19 nt, Artificial Sequence
  source: /note="Description of Artificial Sequence: Synthetic oligonucleotide"
uagggccagcccccacuug

SEQ ID NO: 1225 - RNA, 19 nt, Artificial Sequence
  source: /note="Description of Artificial Sequence: Synthetic oligonucleotide"
ggcccuggcugccguggua

SEQ ID NO: 1226 - RNA, 19 nt, Artificial Sequence
  source: /note="Description of Artificial Sequence: Synthetic oligonucleotide"
uaccacggcagccagggcc

SEQ ID NO: 1227 - RNA, 19 nt, Artificial Sequence
  source: /note="Description of Artificial Sequence: Synthetic oligonucleotide"
ucacagugcucagcucgcu

SEQ ID NO: 1228 - RNA, 19 nt, Artificial Sequence
  source: /note="Description of Artificial Sequence: Synthetic oligonucleotide"
agcgagcugagcacuguga

SEQ ID NO: 1229 - RNA, 19 nt, Artificial Sequence
  source: /note="Description of Artificial Sequence: Synthetic oligonucleotide"
gcugcucaugucuguggga

SEQ ID NO: 1230 - RNA, 19 nt, Artificial Sequence
  source: /note="Description of Artificial Sequence: Synthetic oligonucleotide"
ucccacagacaugagcagc

SEQ ID NO: 1231 - RNA, 19 nt, Artificial Sequence
  source: /note="Description of Artificial Sequence: Synthetic oligonucleotide"
caugucugugggacucuga

SEQ ID NO: 1232 - RNA, 19 nt, Artificial Sequence
  source: /note="Description of Artificial Sequence: Synthetic oligonucleotide"
ucagagucccacagacaug

SEQ ID NO: 1233 - RNA, 19 nt, Artificial Sequence
  source: /note="Description of Artificial Sequence: Synthetic oligonucleotide"
ugcacacucuucggccuga

SEQ ID NO: 1234 - RNA, 19 nt, Artificial Sequence
  source: /note="Description of Artificial Sequence: Synthetic oligonucleotide"
ucaggccgaagagugugca

SEQ ID NO: 1235 - RNA, 19 nt, Artificial Sequence
  source: /note="Description of Artificial Sequence: Synthetic oligonucleotide"
uucggccugacgcccacca

SEQ ID NO: 1236 - RNA, 19 nt, Artificial Sequence
  source: /note="Description of Artificial Sequence: Synthetic oligonucleotide"
uggugggcgucaggccgaa

SEQ ID NO: 1237 - RNA, 19 nt, Artificial Sequence
  source: /note="Description of Artificial Sequence: Synthetic oligonucleotide"
ccucaauggcggcgagauu

SEQ ID NO: 1238 - RNA, 19 nt, Artificial Sequence
  source: /note="Description of Artificial Sequence: Synthetic oligonucleotide"
aaucucgccgccauugagg

SEQ ID NO: 1239 - RNA, 19 nt, Artificial Sequence
  source: /note="Description of Artificial Sequence: Synthetic oligonucleotide"
uuuuccccuaccuuguggu

SEQ ID NO: 1240 - RNA, 19 nt, Artificial Sequence
  source: /note="Description of Artificial Sequence: Synthetic oligonucleotide"
accacaagguaggggaaaa

SEQ ID NO: 1241 - RNA, 19 nt, Artificial Sequence
  source: /note="Description of Artificial Sequence: Synthetic oligonucleotide"
ggugguuauuggguuagaa

SEQ ID NO: 1242 - RNA, 19 nt, Artificial Sequence
  source: /note="Description of Artificial Sequence: Synthetic oligonucleotide"
uucuaacccaauaaccacc

SEQ ID NO: 1243 - RNA, 19 nt, Artificial Sequence
  source: /note="Description of Artificial Sequence: Synthetic oligonucleotide"
uuauuggguuagagaaugu

SEQ ID NO: 1244 - RNA, 19 nt, Artificial Sequence
  source: /note="Description of Artificial Sequence: Synthetic oligonucleotide"
acauucucuaacccaauaa

SEQ ID NO: 1245 - RNA, 19 nt, Artificial Sequence
  source: /note="Description of Artificial Sequence: Synthetic oligonucleotide"
aagucuguggucucaacca

SEQ ID NO: 1246 - RNA, 19 nt, Artificial Sequence
  source: /note="Description of Artificial Sequence: Synthetic oligonucleotide"
ugguugagaccacagacuu

SEQ ID NO: 1247 - RNA, 19 nt, Artificial Sequence
  source: /note="Description of Artificial Sequence: Synthetic oligonucleotide"
ucucaaccccgguagaccu

SEQ ID NO: 1248 - RNA, 19 nt, Artificial Sequence
  source: /note="Description of Artificial Sequence: Synthetic oligonucleotide"
aggucuaccgggguugaga

SEQ ID NO: 1249 - RNA, 19 nt, Artificial Sequence
  source: /note="Description of Artificial Sequence: Synthetic oligonucleotide"
ccuggaggugaagcugcga

SEQ ID NO: 1250 - RNA, 19 nt, Artificial Sequence
  source: /note="Description of Artificial Sequence: Synthetic oligonucleotide"
ucgcagcuucaccuccagg

SEQ ID NO: 1251 - RNA, 19 nt, Artificial Sequence
  source: /note="Description of Artificial Sequence: Synthetic oligonucleotide"
cugcggaucgcccaaggca

SEQ ID NO: 1252 - RNA, 19 nt, Artificial Sequence
  source: /note="Description of Artificial Sequence: Synthetic oligonucleotide"
ugccuugggcgauccgcag

SEQ ID NO: 1253 - RNA, 19 nt, Artificial Sequence
  source: /note="Description of Artificial Sequence: Synthetic oligonucleotide"
ccuaagcagcgagagcuga

SEQ ID NO: 1254 - RNA, 19 nt, Artificial Sequence
  source: /note="Description of Artificial Sequence: Synthetic oligonucleotide"
ucagcucucgcugcuuagg

SEQ ID NO: 1255 - RNA, 19 nt, Artificial Sequence
  source: /note="Description of Artificial Sequence: Synthetic oligonucleotide"
caucaugaagaacauggca

SEQ ID NO: 1256 - RNA, 19 nt, Artificial Sequence
  source: /note="Description of Artificial Sequence: Synthetic oligonucleotide"
ugccauguucuucaugaug

SEQ ID NO: 1257 - RNA, 19 nt, Artificial Sequence
  source: /note="Description of Artificial Sequence: Synthetic oligonucleotide"
gccacggagcugggcauca

SEQ ID NO: 1258 - RNA, 19 nt, Artificial Sequence
  source: /note="Description of Artificial Sequence: Synthetic oligonucleotide"
ugaugcccagcuccguggc

SEQ ID NO: 1259 - RNA, 19 nt, Artificial Sequence
  source: /note="Description of Artificial Sequence: Synthetic oligonucleotide"
ucauccucaucggcuacuu

SEQ ID NO: 1260 - RNA, 19 nt, Artificial Sequence
  source: /note="Description of Artificial Sequence: Synthetic oligonucleotide"
aaguagccgaugaggauga

SEQ ID NO: 1261 - RNA, 19 nt, Artificial Sequence
  source: /note="Description of Artificial Sequence: Synthetic oligonucleotide"
uucacccuagugcccgcca

SEQ ID NO: 1262 - RNA, 19 nt, Artificial Sequence
  source: /note="Description of Artificial Sequence: Synthetic oligonucleotide"
uggcgggcacuagggugaa

SEQ ID NO: 1263 - RNA, 19 nt, Artificial Sequence
  source: /note="Description of Artificial Sequence: Synthetic oligonucleotide"
ccauccaggaguucugucu

SEQ ID NO: 1264 - RNA, 19 nt, Artificial Sequence
  source: /note="Description of Artificial Sequence: Synthetic oligonucleotide"
agacagaacuccuggaugg

SEQ ID NO: 1265 - RNA, 19 nt, Artificial Sequence
  source: /note="Description of Artificial Sequence: Synthetic oligonucleotide"
ucucuuugcugucguggga

SEQ ID NO: 1266 - RNA, 19 nt, Artificial Sequence
  source: /note="Description of Artificial Sequence: Synthetic oligonucleotide"
ucccacgacagcaaagaga

SEQ ID NO: 1267 - RNA, 19 nt, Artificial Sequence
  source: /note="Description of Artificial Sequence: Synthetic oligonucleotide"
uuugcugucguggggcuga

SEQ ID NO: 1268 - RNA, 19 nt, Artificial Sequence
  source: /note="Description of Artificial Sequence: Synthetic oligonucleotide"
ucagccccacgacagcaaa

SEQ ID NO: 1269 - RNA, 19 nt, Artificial Sequence
  source: /note="Description of Artificial Sequence: Synthetic oligonucleotide"
uggugucugacuucuuccu

SEQ ID NO: 1270 - RNA, 19 nt, Artificial Sequence
  source: /note="Description of Artificial Sequence: Synthetic oligonucleotide"
aggaagaagucagacacca

SEQ ID NO: 1271 - RNA, 19 nt, Artificial Sequence
  source: /note="Description of Artificial Sequence: Synthetic oligonucleotide"
uucuuccuucagaugcugu

SEQ ID NO: 1272 - RNA, 19 nt, Artificial Sequence
  source: /note="Description of Artificial Sequence: Synthetic oligonucleotide"
acagcaucugaaggaagaa

SEQ ID NO: 1273 - RNA, 19 nt, Artificial Sequence
  source: /note="Description of Artificial Sequence: Synthetic oligonucleotide"
uguuuuucaccacuguccu

SEQ ID NO: 1274 - RNA, 19 nt, Artificial Sequence
  source: /note="Description of Artificial Sequence: Synthetic oligonucleotide"
aggacaguggugaaaaaca

SEQ ID NO: 1275 - RNA, 19 nt, Artificial Sequence
  source: /note="Description of Artificial Sequence: Synthetic oligonucleotide"
uucaccacuguccugucca

SEQ ID NO: 1276 - RNA, 19 nt, Artificial Sequence
  source: /note="Description of Artificial Sequence: Synthetic oligonucleotide"
uggacaggacaguggugaa

SEQ ID NO: 1277 - RNA, 19 nt, Artificial Sequence
  source: /note="Description of Artificial Sequence: Synthetic oligonucleotide"
acuguccuguccauugaca

SEQ ID NO: 1278 - RNA, 19 nt, Artificial Sequence
  source: /note="Description of Artificial Sequence: Synthetic oligonucleotide"
ugucaauggacaggacagu

SEQ ID NO: 1279 - RNA, 19 nt, Artificial Sequence
  source: /note="Description of Artificial Sequence: Synthetic oligonucleotide"
cauucgccggauggagcua

SEQ ID NO: 1280 - RNA, 19 nt, Artificial Sequence
  source: /note="Description of Artificial Sequence: Synthetic oligonucleotide"
uagcuccauccggcgaaug

SEQ ID NO: 1281 - RNA, 19 nt, Artificial Sequence
  source: /note="Description of Artificial Sequence: Synthetic oligonucleotide"
uagcagaccugaacaagca

SEQ ID NO: 1282 - RNA, 19 nt, Artificial Sequence
  source: /note="Description of Artificial Sequence: Synthetic oligonucleotide"
ugcuuguucaggucugcua

SEQ ID NO: 1283 - RNA, 19 nt, Artificial Sequence
  source: /note="Description of Artificial Sequence: Synthetic oligonucleotide"
gcgacugcccccugaggca

SEQ ID NO: 1284 - RNA, 19 nt, Artificial Sequence
  source: /note="Description of Artificial Sequence: Synthetic oligonucleotide"
ugccucagggggcagucgc

SEQ ID NO: 1285 - RNA, 19 nt, Artificial Sequence
  source: /note="Description of Artificial Sequence: Synthetic oligonucleotide"
gccugccugcccucagcca

SEQ ID NO: 1286 - RNA, 19 nt, Artificial Sequence
  source: /note="Description of Artificial Sequence: Synthetic oligonucleotide"
uggcugagggcaggcaggc

SEQ ID NO: 1287 - RNA, 19 nt, Artificial Sequence
  source: /note="Description of Artificial Sequence: Synthetic oligonucleotide"
caagccagugggacagcca

SEQ ID NO: 1288 - RNA, 19 nt, Artificial Sequence
  source: /note="Description of Artificial Sequence: Synthetic oligonucleotide"
uggcugucccacuggcuug

SEQ ID NO: 1289 - RNA, 19 nt, Artificial Sequence
  source: /note="Description of Artificial Sequence: Synthetic oligonucleotide"
ccaacgcgcuacgagcgga

SEQ ID NO: 1290 - RNA, 19 nt, Artificial Sequence
  source: /note="Description of Artificial Sequence: Synthetic oligonucleotide"
uccgcucguagcgcguugg

SEQ ID NO: 1291 - RNA, 19 nt, Artificial Sequence
  source: /note="Description of Artificial Sequence: Synthetic oligonucleotide"
ggcagcuggcugugaggca

SEQ ID NO: 1292 - RNA, 19 nt, Artificial Sequence
  source: /note="Description of Artificial Sequence: Synthetic oligonucleotide"
ugccucacagccagcugcc

SEQ ID NO: 1293 - RNA, 19 nt, Artificial Sequence
  source: /note="Description of Artificial Sequence: Synthetic oligonucleotide"
ugugaggccguccacacca

SEQ ID NO: 1294 - RNA, 19 nt, Artificial Sequence
  source: /note="Description of Artificial Sequence: Synthetic oligonucleotide"
ugguguggacggccucaca

SEQ ID NO: 1295 - RNA, 19 nt, Artificial Sequence
  source: /note="Description of Artificial Sequence: Synthetic oligonucleotide"
ccccacaccaucacguuga

SEQ ID NO: 1296 - RNA, 19 nt, Artificial Sequence
  source: /note="Description of Artificial Sequence: Synthetic oligonucleotide"
ucaacgugauggugugggg

SEQ ID NO: 1297 - RNA, 19 nt, Artificial Sequence
  source: /note="Description of Artificial Sequence: Synthetic oligonucleotide"
cguugcagccgucuuccuu

SEQ ID NO: 1298 - RNA, 19 nt, Artificial Sequence
  source: /note="Description of Artificial Sequence: Synthetic oligonucleotide"
aaggaagacggcugcaacg

SEQ ID NO: 1299 - RNA, 19 nt, Artificial Sequence
  source: /note="Description of Artificial Sequence: Synthetic oligonucleotide"
uuccgaaaccugcggcuca

SEQ ID NO: 1300 - RNA, 19 nt, Artificial Sequence
  source: /note="Description of Artificial Sequence: Synthetic oligonucleotide"
ugagccgcagguuucggaa

SEQ ID NO: 1301 - RNA, 19 nt, Artificial Sequence
  source: /note="Description of Artificial Sequence: Synthetic oligonucleotide"
uccccaagaggcugcgugu

SEQ ID NO: 1302 - RNA, 19 nt, Artificial Sequence
  source: /note="Description of Artificial Sequence: Synthetic oligonucleotide"
acacgcagccucuugggga

SEQ ID NO: 1303 - RNA, 19 nt, Artificial Sequence
  source: /note="Description of Artificial Sequence: Synthetic oligonucleotide"
ggcugcguguugucuacuu

SEQ ID NO: 1304 - RNA, 19 nt, Artificial Sequence
  source: /note="Description of Artificial Sequence: Synthetic oligonucleotide"
aaguagacaacacgcagcc

SEQ ID NO: 1305 - RNA, 19 nt, Artificial Sequence
  source: /note="Description of Artificial Sequence: Synthetic oligonucleotide"
uuccuggcccgcacccgca

SEQ ID NO: 1306 - RNA, 19 nt, Artificial Sequence
  source: /note="Description of Artificial Sequence: Synthetic oligonucleotide"
ugcgggugcgggccaggaa

SEQ ID NO: 1307 - RNA, 19 nt, Artificial Sequence
  source: /note="Description of Artificial Sequence: Synthetic oligonucleotide"
gccuggcacagcgccucau

SEQ ID NO: 1308 - RNA, 19 nt, Artificial Sequence
  source: /note="Description of Artificial Sequence: Synthetic oligonucleotide"
augaggcgcugugccaggc

SEQ ID NO: 1309 - RNA, 19 nt, Artificial Sequence
  source: /note="Description of Artificial Sequence: Synthetic oligonucleotide"
caucauggcuggcaccguu

SEQ ID NO: 1310 - RNA, 19 nt, Artificial Sequence
  source: /note="Description of Artificial Sequence: Synthetic oligonucleotide"
aacggugccagccaugaug

SEQ ID NO: 1311 - RNA, 19 nt, Artificial Sequence
  source: /note="Description of Artificial Sequence: Synthetic oligonucleotide"
uugucuggauuggcauccu

SEQ ID NO: 1312 - RNA, 19 nt, Artificial Sequence
  source: /note="Description of Artificial Sequence: Synthetic oligonucleotide"
aggaugccaauccagacaa

SEQ ID NO: 1313 - RNA, 19 nt, Artificial Sequence
  source: /note="Description of Artificial Sequence: Synthetic oligonucleotide"
ccugguauacacagaccca

SEQ ID NO: 1314 - RNA, 19 nt, Artificial Sequence
  source: /note="Description of Artificial Sequence: Synthetic oligonucleotide"
ugggucuguguauaccagg

SEQ ID NO: 1315 - RNA, 19 nt, Artificial Sequence
  source: /note="Description of Artificial Sequence: Synthetic oligonucleotide"
acacagacccagcagggcu

SEQ ID NO: 1316 - RNA, 19 nt, Artificial Sequence
  source: /note="Description of Artificial Sequence: Synthetic oligonucleotide"
agcccugcugggucugugu

SEQ ID NO: 1317 - RNA, 19 nt, Artificial Sequence
  source: /note="Description of Artificial Sequence: Synthetic oligonucleotide"
gcugcgcaacuaccucgcu

SEQ ID NO: 1318 - RNA, 19 nt, Artificial Sequence
  source: /note="Description of Artificial Sequence: Synthetic oligonucleotide"
agcgagguaguugcgcagc

SEQ ID NO: 1319 - RNA, 19 nt, Artificial Sequence
  source: /note="Description of Artificial Sequence: Synthetic oligonucleotide"
gcugcccaggugacggaaa

SEQ ID NO: 1320 - RNA, 19 nt, Artificial Sequence
  source: /note="Description of Artificial Sequence: Synthetic oligonucleotide"
uuuccgucaccugggcagc

SEQ ID NO: 1321 - RNA, 19 nt, Artificial Sequence
  source: /note="Description of Artificial Sequence: Synthetic oligonucleotide"
caggugacggaacagagca

SEQ ID NO: 1322 - RNA, 19 nt, Artificial Sequence
  source: /note="Description of Artificial Sequence: Synthetic oligonucleotide"
ugcucuguuccgucaccug

SEQ ID NO: 1323 - RNA, 19 nt, Artificial Sequence
  source: /note="Description of Artificial Sequence: Synthetic oligonucleotide"
cauugggugagggagcccu

SEQ ID NO: 1324 - RNA, 19 nt, Artificial Sequence
  source: /note="Description of Artificial Sequence: Synthetic oligonucleotide"
agggcucccucacccaaug

SEQ ID NO: 1325 - RNA, 19 nt, Artificial Sequence
  source: /note="Description of Artificial Sequence: Synthetic oligonucleotide"
ccuggcucccaugcccgua

SEQ ID NO: 1326 - RNA, 19 nt, Artificial Sequence
  source: /note="Description of Artificial Sequence: Synthetic oligonucleotide"
uacgggcaugggagccagg

SEQ ID NO: 1327 - RNA, 19 nt, Artificial Sequence
  source: /note="Description of Artificial Sequence: Synthetic oligonucleotide"
gugccuaguggcaugcuga

SEQ ID NO: 1328 - RNA, 19 nt, Artificial Sequence
  source: /note="Description of Artificial Sequence: Synthetic oligonucleotide"
ucagcaugccacuaggcac

SEQ ID NO: 1329 - RNA, 19 nt, Artificial Sequence
  source: /note="Description of Artificial Sequence: Synthetic oligonucleotide"
ugccccccagccacccgga

SEQ ID NO: 1330 - RNA, 19 nt, Artificial Sequence
  source: /note="Description of Artificial Sequence: Synthetic oligonucleotide"
uccggguggcuggggggca

SEQ ID NO: 1331 - RNA, 19 nt, Artificial Sequence
  source: /note="Description of Artificial Sequence: Synthetic oligonucleotide"
ccagccacccggacccuga

SEQ ID NO: 1332 - RNA, 19 nt, Artificial Sequence
  source: /note="Description of Artificial Sequence: Synthetic oligonucleotide"
ucaggguccggguggcugg

SEQ ID NO: 1333 - RNA, 19 nt, Artificial Sequence
  source: /note="Description of Artificial Sequence: Synthetic oligonucleotide"
ugccuucuccaucuuccca

SEQ ID NO: 1334 - RNA, 19 nt, Artificial Sequence
  source: /note="Description of Artificial Sequence: Synthetic oligonucleotide"
ugggaagauggagaaggca

SEQ ID NO: 1335 - RNA, 19 nt, Artificial Sequence
  source: /note="Description of Artificial Sequence: Synthetic oligonucleotide"
uucuccaucuucccaccua

SEQ ID NO: 1336 - RNA, 19 nt, Artificial Sequence
  source: /note="Description of Artificial Sequence: Synthetic oligonucleotide"
uaggugggaagauggagaa

SEQ ID NO: 1337 - RNA, 19 nt, Artificial Sequence
  source: /note="Description of Artificial Sequence: Synthetic oligonucleotide"
cugaugccccuaagcuaca

SEQ ID NO: 1338 - RNA, 19 nt, Artificial Sequence
  source: /note="Description of Artificial Sequence: Synthetic oligonucleotide"
uguagcuuaggggcaucag

SEQ ID NO: 1339 - RNA, 19 nt, Artificial Sequence
  source: /note="Description of Artificial Sequence: Synthetic oligonucleotide"
uaagcuaccugagaaccaa

SEQ ID NO: 1340 - RNA, 19 nt, Artificial Sequence
  source: /note="Description of Artificial Sequence: Synthetic oligonucleotide"
uugguucucagguagcuua

SEQ ID NO: 1341 - RNA, 19 nt, Artificial Sequence
  source: /note="Description of Artificial Sequence: Synthetic oligonucleotide"
cagacgucgccaggcgagu

SEQ ID NO: 1342 - RNA, 19 nt, Artificial Sequence
  source: /note="Description of Artificial Sequence: Synthetic oligonucleotide"
acucgccuggcgacgucug

SEQ ID NO: 1343 - RNA, 19 nt, Artificial Sequence
  source: /note="Description of Artificial Sequence: Synthetic oligonucleotide"
agucaccugagcguggaga

SEQ ID NO: 1344 - RNA, 19 nt, Artificial Sequence
  source: /note="Description of Artificial Sequence: Synthetic oligonucleotide"
ucuccacgcucaggugacu

SEQ ID NO: 1345 - RNA, 19 nt, Artificial Sequence
  source: /note="Description of Artificial Sequence: Synthetic oligonucleotide"
agguccagcagagguugua

SEQ ID NO: 1346 - RNA, 19 nt, Artificial Sequence
  source: /note="Description of Artificial Sequence: Synthetic oligonucleotide"
uacaaccucugcuggaccu

SEQ ID NO: 1347 - RNA, 19 nt, Artificial Sequence
  source: /note="Description of Artificial Sequence: Synthetic oligonucleotide"
uuguccaugacagcccagu

SEQ ID NO: 1348 - RNA, 19 nt, Artificial Sequence
  source: /note="Description of Artificial Sequence: Synthetic oligonucleotide"
acugggcugucauggacaa

SEQ ID NO: 1349 - RNA, 19 nt, Artificial Sequence
  source: /note="Description of Artificial Sequence: Synthetic oligonucleotide"
agucccagagguaaccuga

SEQ ID NO: 1350 - RNA, 19 nt, Artificial Sequence
  source: /note="Description of Artificial Sequence: Synthetic oligonucleotide"
ucagguuaccucugggacu

SEQ ID NO: 1351 - RNA, 19 nt, Artificial Sequence
  source: /note="Description of Artificial Sequence: Synthetic oligonucleotide"
cugggggccugaggaugaa

SEQ ID NO: 1352 - RNA, 19 nt, Artificial Sequence
  source: /note="Description of Artificial Sequence: Synthetic oligonucleotide"
uucauccucaggcccccag

SEQ ID NO: 1353 - RNA, 19 nt, Artificial Sequence
  source: /note="Description of Artificial Sequence: Synthetic oligonucleotide"
aggaacuuuggaggaaauu

SEQ ID NO: 1354 - RNA, 19 nt, Artificial Sequence
  source: /note="Description of Artificial Sequence: Synthetic oligonucleotide"
aauuuccuccaaaguuccu

SEQ ID NO: 1355 - RNA, 19 nt, Artificial Sequence
  source: /note="Description of Artificial Sequence: Synthetic oligonucleotide"
auuguccuuccgccacuga

SEQ ID NO: 1356 - RNA, 19 nt, Artificial Sequence
  source: /note="Description of Artificial Sequence: Synthetic oligonucleotide"
ucaguggcggaaggacaau

SEQ ID NO: 1357 - RNA, 19 nt, Artificial Sequence
  source: /note="Description of Artificial Sequence: Synthetic oligonucleotide"
uccgccacuggccgacgcu

SEQ ID NO: 1358 - RNA, 19 nt, Artificial Sequence
  source: /note="Description of Artificial Sequence: Synthetic oligonucleotide"
agcgucggccaguggcgga

SEQ ID NO: 1359 - RNA, 19 nt, Artificial Sequence
  source: /note="Description of Artificial Sequence: Synthetic oligonucleotide"
cgacgcucuucagcuauua

SEQ ID NO: 1360 - RNA, 19 nt, Artificial Sequence
  source: /note="Description of Artificial Sequence: Synthetic oligonucleotide"
uaauagcugaagagcgucg

SEQ ID NO: 1361 - RNA, 19 nt, Artificial Sequence
  source: /note="Description of Artificial Sequence: Synthetic oligonucleotide"
uacaacaucacacuggcca

SEQ ID NO: 1362 - RNA, 19 nt, Artificial Sequence
  source: /note="Description of Artificial Sequence: Synthetic oligonucleotide"
uggccagugugauguugua

SEQ ID NO: 1363 - RNA, 19 nt, Artificial Sequence
  source: /note="Description of Artificial Sequence: Synthetic oligonucleotide"
ccaagagguacaucagccu

SEQ ID NO: 1364 - RNA, 19 nt, Artificial Sequence
  source: /note="Description of Artificial Sequence: Synthetic oligonucleotide"
aggcugauguaccucuugg

SEQ ID NO: 1365 - RNA, 19 nt, Artificial Sequence
  source: /note="Description of Artificial Sequence: Synthetic oligonucleotide"
uacaucagccugcugccca

SEQ ID NO: 1366 - RNA, 19 nt, Artificial Sequence
  source: /note="Description of Artificial Sequence: Synthetic oligonucleotide"
ugggcagcaggcugaugua

SEQ ID NO: 1367 - RNA, 19 nt, Artificial Sequence
  source: /note="Description of Artificial Sequence: Synthetic oligonucleotide"
ccgucaucccagucacgcu

SEQ ID NO: 1368 - RNA, 19 nt, Artificial Sequence
  source: /note="Description of Artificial Sequence: Synthetic oligonucleotide"
agcgugacugggaugacgg

SEQ ID NO: 1369 - RNA, 19 nt, Artificial Sequence
  source: /note="Description of Artificial Sequence: Synthetic oligonucleotide"
gcuccgccugaacccgaga

SEQ ID NO: 1370 - RNA, 19 nt, Artificial Sequence
  source: /note="Description of Artificial Sequence: Synthetic oligonucleotide"
ucucggguucaggcggagc

SEQ ID NO: 1371 - RNA, 19 nt, Artificial Sequence
  source: /note="Description of Artificial Sequence: Synthetic oligonucleotide"
gcucuggagggccggcaca

SEQ ID NO: 1372 - RNA, 19 nt, Artificial Sequence
  source: /note="Description of Artificial Sequence: Synthetic oligonucleotide"
ugugccggcccuccagagc

SEQ ID NO: 1373 - RNA, 19 nt, Artificial Sequence
  source: /note="Description of Artificial Sequence: Synthetic oligonucleotide"
acccucaggacggccgcaa

SEQ ID NO: 1374 - RNA, 19 nt, Artificial Sequence
  source: /note="Description of Artificial Sequence: Synthetic oligonucleotide"
uugcggccguccugagggu

SEQ ID NO: 1375 - RNA, 19 nt, Artificial Sequence
  source: /note="Description of Artificial Sequence: Synthetic oligonucleotide"
ccaccggggcccauaccua

SEQ ID NO: 1376 - RNA, 19 nt, Artificial Sequence
  source: /note="Description of Artificial Sequence: Synthetic oligonucleotide"
uagguaugggccccggugg

SEQ ID NO: 1377 - RNA, 19 nt, Artificial Sequence
  source: /note="Description of Artificial Sequence: Synthetic oligonucleotide"
ugcugggcacugggaagca

SEQ ID NO: 1378 - RNA, 19 nt, Artificial Sequence
  source: /note="Description of Artificial Sequence: Synthetic oligonucleotide"
ugcuucccagugcccagca

SEQ ID NO: 1379 - RNA, 19 nt, Artificial Sequence
  source: /note="Description of Artificial Sequence: Synthetic oligonucleotide"
caggacccaagggcccaga

SEQ ID NO: 1380 - RNA, 19 nt, Artificial Sequence
  source: /note="Description of Artificial Sequence: Synthetic oligonucleotide"
ucugggcccuuggguccug

SEQ ID NO: 1381 - RNA, 19 nt, Artificial Sequence
  source: /note="Description of Artificial Sequence: Synthetic oligonucleotide"
agguggggugcaggcccau

SEQ ID NO: 1382 - RNA, 19 nt, Artificial Sequence
  source: /note="Description of Artificial Sequence: Synthetic oligonucleotide"
augggccugcaccccaccu

SEQ ID NO: 1383 - RNA, 19 nt, Artificial Sequence
  source: /note="Description of Artificial Sequence: Synthetic oligonucleotide"
caggcccauggagacguca

SEQ ID NO: 1384 - RNA, 19 nt, Artificial Sequence
  source: /note="Description of Artificial Sequence: Synthetic oligonucleotide"
ugacgucuccaugggccug

SEQ ID NO: 1385 - RNA, 19 nt, Artificial Sequence
  source: /note="Description of Artificial Sequence: Synthetic oligonucleotide"
ucacgcuguacaaggugga

SEQ ID NO: 1386 - RNA, 19 nt, Artificial Sequence
  source: /note="Description of Artificial Sequence: Synthetic oligonucleotide"
uccaccuuguacagcguga

SEQ ID NO: 1387 - RNA, 19 nt, Artificial Sequence
  source: /note="Description of Artificial Sequence: Synthetic oligonucleotide"
uguacaagguggcggcgcu

SEQ ID NO: 1388 - RNA, 19 nt, Artificial Sequence
  source: /note="Description of Artificial Sequence: Synthetic oligonucleotide"
agcgccgccaccuuguaca

SEQ ID NO: 1389 - RNA, 19 nt, Artificial Sequence
  source: /note="Description of Artificial Sequence: Synthetic oligonucleotide"
gcugggccuggccaccgga

SEQ ID NO: 1390 - RNA, 19 nt, Artificial Sequence
  source: /note="Description of Artificial Sequence: Synthetic oligonucleotide"
uccgguggccaggcccagc

SEQ ID NO: 1391 - RNA, 19 nt, Artificial Sequence
  source: /note="Description of Artificial Sequence: Synthetic oligonucleotide"
uggccaccggcaucgucuu

SEQ ID NO: 1392 - RNA, 19 nt, Artificial Sequence
  source: /note="Description of Artificial Sequence: Synthetic oligonucleotide"
aagacgaugccgguggcca

SEQ ID NO: 1393 - RNA, 19 nt, Artificial Sequence
  source: /note="Description of Artificial Sequence: Synthetic oligonucleotide"
ucugccucuaccgcgugcu

SEQ ID NO: 1394 - RNA, 19 nt, Artificial Sequence
  source: /note="Description of Artificial Sequence: Synthetic oligonucleotide"
agcacgcgguagaggcaga

SEQ ID NO: 1395 - RNA, 19 nt, Artificial Sequence
  source: /note="Description of Artificial Sequence: Synthetic oligonucleotide"
gcuaugcccgcgcaacuaa

SEQ ID NO: 1396 - RNA, 19 nt, Artificial Sequence
  source: /note="Description of Artificial Sequence: Synthetic oligonucleotide"
uuaguugcgcgggcauagc

SEQ ID NO: 1397 - RNA, 19 nt, Artificial Sequence
  source: /note="Description of Artificial Sequence: Synthetic oligonucleotide"
cgcaacuacgggcagcuga

SEQ ID NO: 1398 - RNA, 19 nt, Artificial Sequence
  source: /note="Description of Artificial Sequence: Synthetic oligonucleotide"
ucagcugcccguaguugcg

SEQ ID NO: 1399 - RNA, 19 nt, Artificial Sequence
  source: /note="Description of Artificial Sequence: Synthetic oligonucleotide"
cggaggcgcggggagcuga

SEQ ID NO: 1400 - RNA, 19 nt, Artificial Sequence
  source: /note="Description of Artificial Sequence: Synthetic oligonucleotide"
ucagcuccccgcgccuccg

SEQ ID NO: 1401 - RNA, 19 nt, Artificial Sequence
  source: /note="Description of Artificial Sequence: Synthetic oligonucleotide"
ugcccugcgacgacuacga

SEQ ID NO: 1402 - RNA, 19 nt, Artificial Sequence
  source: /note="Description of Artificial Sequence: Synthetic oligonucleotide"
ucguagucgucgcagggca

SEQ ID NO: 1403 - RNA, 19 nt, Artificial Sequence
  source: /note="Description of Artificial Sequence: Synthetic oligonucleotide"
uacggcuaugcgccaccca

SEQ ID NO: 1404 - RNA, 19 nt, Artificial Sequence
  source: /note="Description of Artificial Sequence: Synthetic oligonucleotide"
uggguggcgcauagccgua

SEQ ID NO: 1405 - RNA, 19 nt, Artificial Sequence
  source: /note="Description of Artificial Sequence: Synthetic oligonucleotide"
ccgagacggagaucgugca

SEQ ID NO: 1406 - RNA, 19 nt, Artificial Sequence
  source: /note="Description of Artificial Sequence: Synthetic oligonucleotide"
ugcacgaucuccgucucgg

SEQ ID NO: 1407 - RNA, 19 nt, Artificial Sequence
  source: /note="Description of Artificial Sequence: Synthetic oligonucleotide"
gacggagaucgugccgcuu

SEQ ID NO: 1408 - RNA, 19 nt, Artificial Sequence
  source: /note="Description of Artificial Sequence: Synthetic oligonucleotide"
aagcggcacgaucuccguc

SEQ ID NO: 1409 - RNA, 19 nt, Artificial Sequence
  source: /note="Description of Artificial Sequence: Synthetic oligonucleotide"
uugugcugcgcggccaccu

SEQ ID NO: 1410 - RNA, 19 nt, Artificial Sequence
  source: /note="Description of Artificial Sequence: Synthetic oligonucleotide"
agguggccgcgcagcacaa

SEQ ID NO: 1411 - RNA, 19 nt, Artificial Sequence
  source: /note="Description of Artificial Sequence: Synthetic oligonucleotide"
ccucauggacaucgaguga

SEQ ID NO: 1412 - RNA, 19 nt, Artificial Sequence
  source: /note="Description of Artificial Sequence: Synthetic oligonucleotide"
ucacucgauguccaugagg

SEQ ID NO: 1413 - RNA, 19 nt, Artificial Sequence
  source: /note="Description of Artificial Sequence: Synthetic oligonucleotide"
ugccuggccagcgacggca

SEQ ID NO: 1414 - RNA, 19 nt, Artificial Sequence
  source: /note="Description of Artificial Sequence: Synthetic oligonucleotide"
ugccgucgcuggccaggca

SEQ ID NO: 1415 - RNA, 19 nt, Artificial Sequence
  source: /note="Description of Artificial Sequence: Synthetic oligonucleotide"
gcaugcugcuggugagcua

SEQ ID NO: 1416 - RNA, 19 nt, Artificial Sequence
  source: /note="Description of Artificial Sequence: Synthetic oligonucleotide"
uagcucaccagcagcaugc

SEQ ID NO: 1417 - RNA, 19 nt, Artificial Sequence
  source: /note="Description of Artificial Sequence: Synthetic oligonucleotide"
ucugcgugugggacgcgca

SEQ ID NO: 1418 - RNA, 19 nt, Artificial Sequence
  source: /note="Description of Artificial Sequence: Synthetic oligonucleotide"
ugcgcgucccacacgcaga

SEQ ID NO: 1419 - RNA, 19 nt, Artificial Sequence
  source: /note="Description of Artificial Sequence: Synthetic oligonucleotide"
gacgcgcagaccggggauu

SEQ ID NO: 1420 - RNA, 19 nt, Artificial Sequence
  source: /note="Description of Artificial Sequence: Synthetic oligonucleotide"
aauccccggucugcgcguc

SEQ ID NO: 1421 - RNA, 19 nt, Artificial Sequence
  source: /note="Description of Artificial Sequence: Synthetic oligonucleotide"
uugccuaacgcgcauucca

SEQ ID NO: 1422 - RNA, 19 nt, Artificial Sequence
  source: /note="Description of Artificial Sequence: Synthetic oligonucleotide"
uggaaugcgcguuaggcaa

SEQ ID NO: 1423 - RNA, 19 nt, Artificial Sequence
  source: /note="Description of Artificial Sequence: Synthetic oligonucleotide"
ccgcgcccaggcaggcaga

SEQ ID NO: 1424 - RNA, 19 nt, Artificial Sequence
  source: /note="Description of Artificial Sequence: Synthetic oligonucleotide"
ucugccugccugggcgcgg

SEQ ID NO: 1425 - RNA, 19 nt, Artificial Sequence
  source: /note="Description of Artificial Sequence: Synthetic oligonucleotide"
agcgccgggacaguggcgu

SEQ ID NO: 1426 - RNA, 19 nt, Artificial Sequence
  source: /note="Description of Artificial Sequence: Synthetic oligonucleotide"
acgccacugucccggcgcu

SEQ ID NO: 1427 - RNA, 19 nt, Artificial Sequence
  source: /note="Description of Artificial Sequence: Synthetic oligonucleotide"
cgggacaguggcgugggca

SEQ ID NO: 1428 - RNA, 19 nt, Artificial Sequence
  source: /note="Description of Artificial Sequence: Synthetic oligonucleotide"
ugcccacgccacugucccg

SEQ ID NO: 1429 - RNA, 19 nt, Artificial Sequence
  source: /note="Description of Artificial Sequence: Synthetic oligonucleotide"
cagcgggcuugaggcucaa

SEQ ID NO: 1430 - RNA, 19 nt, Artificial Sequence
  source: /note="Description of Artificial Sequence: Synthetic oligonucleotide"
uugagccucaagcccgcug

SEQ ID NO: 1431 - RNA, 19 nt, Artificial Sequence
  source: /note="Description of Artificial Sequence: Synthetic oligonucleotide"
aggagagcugggaacgacu

SEQ ID NO: 1432 - RNA, 19 nt, Artificial Sequence
  source: /note="Description of Artificial Sequence: Synthetic oligonucleotide"
agucguucccagcucuccu

SEQ ID NO: 1433 - RNA, 19 nt, Artificial Sequence
  source: /note="Description of Artificial Sequence: Synthetic oligonucleotide"
uucagauggugggaaggcu

SEQ ID NO: 1434 - RNA, 19 nt, Artificial Sequence
  source: /note="Description of Artificial Sequence: Synthetic oligonucleotide"
agccuucccaccaucugaa

SEQ ID NO: 1435 - RNA, 19 nt, Artificial Sequence
  source: /note="Description of Artificial Sequence: Synthetic oligonucleotide"
ccuccccugagacaccgca

SEQ ID NO: 1436 - RNA, 19 nt, Artificial Sequence
  source: /note="Description of Artificial Sequence: Synthetic oligonucleotide"
ugcggugucucaggggagg

SEQ ID NO: 1437 - RNA, 19 nt, Artificial Sequence
  source: /note="Description of Artificial Sequence: Synthetic oligonucleotide"
cuccgccgccuucccucuu

SEQ ID NO: 1438 - RNA, 19 nt, Artificial Sequence
  source: /note="Description of Artificial Sequence: Synthetic oligonucleotide"
aagagggaaggcggcggag

SEQ ID NO: 1439 - RNA, 19 nt, Artificial Sequence
  source: /note="Description of Artificial Sequence: Synthetic oligonucleotide"
uucggggaccagccugaca

SEQ ID NO: 1440 - RNA, 19 nt, Artificial Sequence
  source: /note="Description of Artificial Sequence: Synthetic oligonucleotide"
ugucaggcugguccccgaa

SEQ ID NO: 1441 - RNA, 19 nt, Artificial Sequence
  source: /note="Description of Artificial Sequence: Synthetic oligonucleotide"
accucaccugcuuaauuga

SEQ ID NO: 1442 - RNA, 19 nt, Artificial Sequence
  source: /note="Description of Artificial Sequence: Synthetic oligonucleotide"
ucaauuaagcaggugaggu

SEQ ID NO: 1443 - RNA, 19 nt, Artificial Sequence
  source: /note="Description of Artificial Sequence: Synthetic oligonucleotide"
uuaauugacaccaacuuuu

SEQ ID NO: 1444 - RNA, 19 nt, Artificial Sequence
  source: /note="Description of Artificial Sequence: Synthetic oligonucleotide"
aaaaguuggugucaauuaa

SEQ ID NO: 1445 - RNA, 19 nt, Artificial Sequence
  source: /note="Description of Artificial Sequence: Synthetic oligonucleotide"
uuucagcgcagccucggua

SEQ ID NO: 1446 - RNA, 19 nt, Artificial Sequence
  source: /note="Description of Artificial Sequence: Synthetic oligonucleotide"
uaccgaggcugcgcugaaa

SEQ ID NO: 1447 - RNA, 19 nt, Artificial Sequence
  source: /note="Description of Artificial Sequence: Synthetic oligonucleotide"
guccucacagcccacucaa

SEQ ID NO: 1448 - RNA, 19 nt, Artificial Sequence
  source: /note="Description of Artificial Sequence: Synthetic oligonucleotide"
uugagugggcugugaggac

SEQ ID NO: 1449 - RNA, 19 nt, Artificial Sequence
  source: /note="Description of Artificial Sequence: Synthetic oligonucleotide"
cagcccgagccccggcaca

SEQ ID NO: 1450 - RNA, 19 nt, Artificial Sequence
  source: /note="Description of Artificial Sequence: Synthetic oligonucleotide"
ugugccggggcucgggcug

SEQ ID NO: 1451 - RNA, 19 nt, Artificial Sequence
  source: /note="Description of Artificial Sequence: Synthetic oligonucleotide"
ccggcaccgggcggucugu

SEQ ID NO: 1452 - RNA, 19 nt, Artificial Sequence
  source: /note="Description of Artificial Sequence: Synthetic oligonucleotide"
acagaccgcccggugccgg

SEQ ID NO: 1453 - RNA, 19 nt, Artificial Sequence
  source: /note="Description of Artificial Sequence: Synthetic oligonucleotide"
uguggccgcucucgggacu

SEQ ID NO: 1454 - RNA, 19 nt, Artificial Sequence
  source: /note="Description of Artificial Sequence: Synthetic oligonucleotide"
agucccgagagcggccaca

SEQ ID NO: 1455 - RNA, 19 nt, Artificial Sequence
  source: /note="Description of Artificial Sequence: Synthetic oligonucleotide"
ucucgggacuccccaggcu

SEQ ID NO: 1456 - RNA, 19 nt, Artificial Sequence
  source: /note="Description of Artificial Sequence: Synthetic oligonucleotide"
agccuggggagucccgaga

SEQ ID NO: 1457 - RNA, 19 nt, Artificial Sequence
  source: /note="Description of Artificial Sequence: Synthetic oligonucleotide"
cugccuggugcagcgggua

SEQ ID NO: 1458 - RNA, 19 nt, Artificial Sequence
  source: /note="Description of Artificial Sequence: Synthetic oligonucleotide"
uacccgcugcaccaggcag

SEQ ID NO: 1459 - RNA, 19 nt, Artificial Sequence
  source: /note="Description of Artificial Sequence: Synthetic oligonucleotide"
uguaccaggaggaggggcu

SEQ ID NO: 1460 - RNA, 19 nt, Artificial Sequence
  source: /note="Description of Artificial Sequence: Synthetic oligonucleotide"
agccccuccuccugguaca

SEQ ID NO: 1461 - RNA, 19 nt, Artificial Sequence
  source: /note="Description of Artificial Sequence: Synthetic oligonucleotide"
gcuggcggccgucugcaca

SEQ ID NO: 1462 - RNA, 19 nt, Artificial Sequence
  source: /note="Description of Artificial Sequence: Synthetic oligonucleotide"
ugugcagacggccgccagc

SEQ ID NO: 1463 - RNA, 19 nt, Artificial Sequence
  source: /note="Description of Artificial Sequence: Synthetic oligonucleotide"
ccagcccugcgcccacccu

SEQ ID NO: 1464 - RNA, 19 nt, Artificial Sequence
  source: /note="Description of Artificial Sequence: Synthetic oligonucleotide"
agggugggcgcagggcugg

SEQ ID NO: 1465 - RNA, 19 nt, Artificial Sequence
  source: /note="Description of Artificial Sequence: Synthetic oligonucleotide"
ccucgccugggccggugcu

SEQ ID NO: 1466 - RNA, 19 nt, Artificial Sequence
  source: /note="Description of Artificial Sequence: Synthetic oligonucleotide"
agcaccggcccaggcgagg

SEQ ID NO: 1467 - RNA, 19 nt, Artificial Sequence
  source: /note="Description of Artificial Sequence: Synthetic oligonucleotide"
cggugcugucccaggccca

SEQ ID NO: 1468 - RNA, 19 nt, Artificial Sequence
  source: /note="Description of Artificial Sequence: Synthetic oligonucleotide"
ugggccugggacagcaccg

SEQ ID NO: 1469 - RNA, 19 nt, Artificial Sequence
  source: /note="Description of Artificial Sequence: Synthetic oligonucleotide"
ccugaggacgaggguggcu

SEQ ID NO: 1470 - RNA, 19 nt, Artificial Sequence
  source: /note="Description of Artificial Sequence: Synthetic oligonucleotide"
agccacccucguccucagg

SEQ ID NO: 1471 - RNA, 19 nt, Artificial Sequence
  source: /note="Description of Artificial Sequence: Synthetic oligonucleotide"
gcucccccgagaaaggcua

SEQ ID NO: 1472 - RNA, 19 nt, Artificial Sequence
  source: /note="Description of Artificial Sequence: Synthetic oligonucleotide"
uagccuuucucgggggagc

SEQ ID NO: 1473 - RNA, 19 nt, Artificial Sequence
  source: /note="Description of Artificial Sequence: Synthetic oligonucleotide"
cccgagaaaggcuccccuu

SEQ ID NO: 1474 - RNA, 19 nt, Artificial Sequence
  source: /note="Description of Artificial Sequence: Synthetic oligonucleotide"
aaggggagccuuucucggg

SEQ ID NO: 1475 - RNA, 19 nt, Artificial Sequence
  source: /note="Description of Artificial Sequence: Synthetic oligonucleotide"
uucccucgccugggcccca

SEQ ID NO: 1476 - RNA, 19 nt, Artificial Sequence
  source: /note="Description of Artificial Sequence: Synthetic oligonucleotide"
uggggcccaggcgagggaa

SEQ ID NO: 1477 - RNA, 19 nt, Artificial Sequence
  source: /note="Description of Artificial Sequence: Synthetic oligonucleotide"
cccagugccgaggguucca

SEQ ID NO: 1478 - RNA, 19 nt, Artificial Sequence
  source: /note="Description of Artificial Sequence: Synthetic oligonucleotide"
uggaacccucggcacuggg

SEQ ID NO: 1479 - RNA, 19 nt, Artificial Sequence
  source: /note="Description of Artificial Sequence: Synthetic oligonucleotide"
aggguuccaucuggagcuu

SEQ ID NO: 1480 - RNA, 19 nt, Artificial Sequence
  source: /note="Description of Artificial Sequence: Synthetic oligonucleotide"
aagcuccagauggaacccu

SEQ ID NO: 1481 - RNA, 19 nt, Artificial Sequence
  source: /note="Description of Artificial Sequence: Synthetic oligonucleotide"
uuggagcugcagggcaaca

SEQ ID NO: 1482 - RNA, 19 nt, Artificial Sequence
  source: /note="Description of Artificial Sequence: Synthetic oligonucleotide"
uguugcccugcagcuccaa

SEQ ID NO: 1483 - RNA, 19 nt, Artificial Sequence
  source: /note="Description of Artificial Sequence: Synthetic oligonucleotide"
accucaucgugguggggca

SEQ ID NO: 1484 - RNA, 19 nt, Artificial Sequence
  source: /note="Description of Artificial Sequence: Synthetic oligonucleotide"
ugccccaccacgaugaggu

SEQ ID NO: 1485 - RNA, 19 nt, Artificial Sequence
  source: /note="Description of Artificial Sequence: Synthetic oligonucleotide"
gcggagcagcggccggcua

SEQ ID NO: 1486 - RNA, 19 nt, Artificial Sequence
  source: /note="Description of Artificial Sequence: Synthetic oligonucleotide"
uagccggccgcugcuccgc

SEQ ID NO: 1487 - RNA, 19 nt, Artificial Sequence
  source: /note="Description of Artificial Sequence: Synthetic oligonucleotide"
acgccauugaaggggugcu

SEQ ID NO: 1488 - RNA, 19 nt, Artificial Sequence
  source: /note="Description of Artificial Sequence: Synthetic oligonucleotide"
agcaccccuucaauggcgu

SEQ ID NO: 1489 - RNA, 19 nt, Artificial Sequence
  source: /note="Description of Artificial Sequence: Synthetic oligonucleotide"
ugcagcagcgaggaggucu

SEQ ID NO: 1490 - RNA, 19 nt, Artificial Sequence
  source: /note="Description of Artificial Sequence: Synthetic oligonucleotide"
agaccuccucgcugcugca

SEQ ID NO: 1491 - RNA, 19 nt, Artificial Sequence
  source: /note="Description of Artificial Sequence: Synthetic oligonucleotide"
ucuccucaggcauuaccga

SEQ ID NO: 1492 - RNA, 19 nt, Artificial Sequence
  source: /note="Description of Artificial Sequence: Synthetic oligonucleotide"
ucgguaaugccugaggaga

SEQ ID NO: 1493 - RNA, 19 nt, Artificial Sequence
  source: /note="Description of Artificial Sequence: Synthetic oligonucleotide"
cgcucugguguucuuggaa

SEQ ID NO: 1494 - RNA, 19 nt, Artificial Sequence
  source: /note="Description of Artificial Sequence: Synthetic oligonucleotide"
uuccaagaacaccagagcg

SEQ ID NO: 1495 - RNA, 19 nt, Artificial Sequence
  source: /note="Description of Artificial Sequence: Synthetic oligonucleotide"
uucuuggacaaaaggauua

SEQ ID NO: 1496 - RNA, 19 nt, Artificial Sequence
  source: /note="Description of Artificial Sequence: Synthetic oligonucleotide"
uaauccuuuuguccaagaa

SEQ ID NO: 1497 - RNA, 19 nt, Artificial Sequence
  source: /note="Description of Artificial Sequence: Synthetic oligonucleotide"
ugcacggcucaacgguuca

SEQ ID NO: 1498 - RNA, 19 nt, Artificial Sequence
  source: /note="Description of Artificial Sequence: Synthetic oligonucleotide"
ugaaccguugagccgugca

SEQ ID NO: 1499 - RNA, 19 nt, Artificial Sequence
  source: /note="Description of Artificial Sequence: Synthetic oligonucleotide"
cccuugauuucuucuccuu

SEQ ID NO: 1500 - RNA, 19 nt, Artificial Sequence
  source: /note="Description of Artificial Sequence: Synthetic oligonucleotide"
aaggagaagaaaucaaggg

SEQ ID NO: 1501 - RNA, 19 nt, Artificial Sequence
  source: /note="Description of Artificial Sequence: Synthetic oligonucleotide"
uuggagacccacacugcca

SEQ ID NO: 1502 - RNA, 19 nt, Artificial Sequence
  source: /note="Description of Artificial Sequence: Synthetic oligonucleotide"
uggcagugugggucuccaa

SEQ ID NO: 1503 - RNA, 19 nt, Artificial Sequence
  source: /note="Description of Artificial Sequence: Synthetic oligonucleotide"
cccucagcccccugcaguu

SEQ ID NO: 1504 - RNA, 19 nt, Artificial Sequence
  source: /note="Description of Artificial Sequence: Synthetic oligonucleotide"
aacugcagggggcugaggg

SEQ ID NO: 1505 - RNA, 19 nt, Artificial Sequence
  source: /note="Description of Artificial Sequence: Synthetic oligonucleotide"
uuagagggaccccagggca

SEQ ID NO: 1506 - RNA, 19 nt, Artificial Sequence
  source: /note="Description of Artificial Sequence: Synthetic oligonucleotide"
ugcccuggggucccucuaa

SEQ ID NO: 1507 - RNA, 19 nt, Artificial Sequence
  source: /note="Description of Artificial Sequence: Synthetic oligonucleotide"
gcggggcaguuccccugca

SEQ ID NO: 1508 - RNA, 19 nt, Artificial Sequence
  source: /note="Description of Artificial Sequence: Synthetic oligonucleotide"
ugcaggggaacugccccgc

SEQ ID NO: 1509 - RNA, 19 nt, Artificial Sequence
  source: /note="Description of Artificial Sequence: Synthetic oligonucleotide"
ccccugccucuccagugua

SEQ ID NO: 1510 - RNA, 19 nt, Artificial Sequence
  source: /note="Description of Artificial Sequence: Synthetic oligonucleotide"
uacacuggagaggcagggg

SEQ ID NO: 1511 - RNA, 19 nt, Artificial Sequence
  source: /note="Description of Artificial Sequence: Synthetic oligonucleotide"
uacagcagcagcgacacaa

SEQ ID NO: 1512 - RNA, 19 nt, Artificial Sequence
  source: /note="Description of Artificial Sequence: Synthetic oligonucleotide"
uugugucgcugcugcugua

SEQ ID NO: 1513 - RNA, 19 nt, Artificial Sequence
  source: /note="Description of Artificial Sequence: Synthetic oligonucleotide"
gacccacacagugcccugu

SEQ ID NO: 1514 - RNA, 19 nt, Artificial Sequence
  source: /note="Description of Artificial Sequence: Synthetic oligonucleotide"
acagggcacuguguggguc

SEQ ID NO: 1515 - RNA, 19 nt, Artificial Sequence
  source: /note="Description of Artificial Sequence: Synthetic oligonucleotide"
agugcccugugcacaccaa

SEQ ID NO: 1516 - RNA, 19 nt, Artificial Sequence
  source: /note="Description of Artificial Sequence: Synthetic oligonucleotide"
uuggugugcacagggcacu

SEQ ID NO: 1517 - RNA, 19 nt, Artificial Sequence
  source: /note="Description of Artificial Sequence: Synthetic oligonucleotide"
aaaaacccaucacagcccu

SEQ ID NO: 1518 - RNA, 19 nt, Artificial Sequence
  source: /note="Description of Artificial Sequence: Synthetic oligonucleotide"
agggcugugauggguuuuu

SEQ ID NO: 1519 - RNA, 19 nt, Artificial Sequence
  source: /note="Description of Artificial Sequence: Synthetic oligonucleotide"
ccugaaagccgcugcugga

SEQ ID NO: 1520 - RNA, 19 nt, Artificial Sequence
  source: /note="Description of Artificial Sequence: Synthetic oligonucleotide"
uccagcagcggcuuucagg

SEQ ID NO: 1521 - RNA, 19 nt, Artificial Sequence
  source: /note="Description of Artificial Sequence: Synthetic oligonucleotide"
gggcgcuuggugacuggga

SEQ ID NO: 1522 - RNA, 19 nt, Artificial Sequence
  source: /note="Description of Artificial Sequence: Synthetic oligonucleotide"
ucccagucaccaagcgccc

SEQ ID NO: 1523 - RNA, 19 nt, Artificial Sequence
  source: /note="Description of Artificial Sequence: Synthetic oligonucleotide"
uuggugacugggagccaaa

SEQ ID NO: 1524 - RNA, 19 nt, Artificial Sequence
  source: /note="Description of Artificial Sequence: Synthetic oligonucleotide"
uuuggcucccagucaccaa

SEQ ID NO: 1525 - RNA, 19 nt, Artificial Sequence
  source: /note="Description of Artificial Sequence: Synthetic oligonucleotide"
aagaccacacacugagagu

SEQ ID NO: 1526 - RNA, 19 nt, Artificial Sequence
  source: /note="Description of Artificial Sequence: Synthetic oligonucleotide"
acucucaguguguggucuu

SEQ ID NO: 1527 - RNA, 19 nt, Artificial Sequence
  source: /note="Description of Artificial Sequence: Synthetic oligonucleotide"
aguguuccgucuggaggaa

SEQ ID NO: 1528 - RNA, 19 nt, Artificial Sequence
  source: /note="Description of Artificial Sequence: Synthetic oligonucleotide"
uuccuccagacggaacacu

SEQ ID NO: 1529 - RNA, 19 nt, Artificial Sequence
  source: /note="Description of Artificial Sequence: Synthetic oligonucleotide"
uuccgucuggaggacucgu

SEQ ID NO: 1530 - RNA, 19 nt, Artificial Sequence
  source: /note="Description of Artificial Sequence: Synthetic oligonucleotide"
acgaguccuccagacggaa

SEQ ID NO: 1531 - RNA, 19 nt, Artificial Sequence
  source: /note="Description of Artificial Sequence: Synthetic oligonucleotide"
aggacucgugcugccucuu

SEQ ID NO: 1532 - RNA, 19 nt, Artificial Sequence
  source: /note="Description of Artificial Sequence: Synthetic oligonucleotide"
aagaggcagcacgaguccu

SEQ ID NO: 1533 - RNA, 19 nt, Artificial Sequence
  source: /note="Description of Artificial Sequence: Synthetic oligonucleotide"
uucacccuucagggccacu

SEQ ID NO: 1534 - RNA, 19 nt, Artificial Sequence
  source: /note="Description of Artificial Sequence: Synthetic oligonucleotide"
aguggcccugaagggugaa

SEQ ID NO: 1535 - RNA, 19 nt, Artificial Sequence
  source: /note="Description of Artificial Sequence: Synthetic oligonucleotide"
acucaggggccaucacgaa

SEQ ID NO: 1536 - RNA, 19 nt, Artificial Sequence
  source: /note="Description of Artificial Sequence: Synthetic oligonucleotide"
uucgugauggccccugagu

SEQ ID NO: 1537 - RNA, 19 nt, Artificial Sequence
  source: /note="Description of Artificial Sequence: Synthetic oligonucleotide"
caucacgaccguguacauu

SEQ ID NO: 1538 - RNA, 19 nt, Artificial Sequence
  source: /note="Description of Artificial Sequence: Synthetic oligonucleotide"
aauguacacggucgugaug

SEQ ID NO: 1539 - RNA, 19 nt, Artificial Sequence
  source: /note="Description of Artificial Sequence: Synthetic oligonucleotide"
auggugcuggccaguggaa

SEQ ID NO: 1540 - RNA, 19 nt, Artificial Sequence
  source: /note="Description of Artificial Sequence: Synthetic oligonucleotide"
uuccacuggccagcaccau

SEQ ID NO: 1541 - RNA, 19 nt, Artificial Sequence
  source: /note="Description of Artificial Sequence: Synthetic oligonucleotide"
aggacaagauggggccaua

SEQ ID NO: 1542 - RNA, 19 nt, Artificial Sequence
  source: /note="Description of Artificial Sequence: Synthetic oligonucleotide"
uauggccccaucuuguccu

SEQ ID NO: 1543 - RNA, 19 nt, Artificial Sequence
  source: /note="Description of Artificial Sequence: Synthetic oligonucleotide"
ucugccugugggauguacu

SEQ ID NO: 1544 - RNA, 19 nt, Artificial Sequence
  source: /note="Description of Artificial Sequence: Synthetic oligonucleotide"
aguacaucccacaggcaga

SEQ ID NO: 1545 - RNA, 19 nt, Artificial Sequence
  source: /note="Description of Artificial Sequence: Synthetic oligonucleotide"
agccgggucagccaugugu

SEQ ID NO: 1546 - RNA, 19 nt, Artificial Sequence
  source: /note="Description of Artificial Sequence: Synthetic oligonucleotide"
acacauggcugacccggcu

SEQ ID NO: 1547 - RNA, 19 nt, Artificial Sequence
  source: /note="Description of Artificial Sequence: Synthetic oligonucleotide"
uugcucaccguggggaugu

SEQ ID NO: 1548 - RNA, 19 nt, Artificial Sequence
  source: /note="Description of Artificial Sequence: Synthetic oligonucleotide"
acauccccacggugagcaa

SEQ ID NO: 1549 - RNA, 19 nt, Artificial Sequence
  source: /note="Description of Artificial Sequence: Synthetic oligonucleotide"
ggggaugucaccucccuua

SEQ ID NO: 1550 - RNA, 19 nt, Artificial Sequence
  source: /note="Description of Artificial Sequence: Synthetic oligonucleotide"
uaagggaggugacaucccc

SEQ ID NO: 1551 - RNA, 19 nt, Artificial Sequence
  source: /note="Description of Artificial Sequence: Synthetic oligonucleotide"
uaccuguaccaccuccugu

SEQ ID NO: 1552 - RNA, 19 nt, Artificial Sequence
  source: /note="Description of Artificial Sequence: Synthetic oligonucleotide"
acaggaggugguacaggua

SEQ ID NO: 1553 - RNA, 19 nt, Artificial Sequence
  source: /note="Description of Artificial Sequence: Synthetic oligonucleotide"
ccugugucaucagcaguga

SEQ ID NO: 1554 - RNA, 19 nt, Artificial Sequence
  source: /note="Description of Artificial Sequence: Synthetic oligonucleotide"
ucacugcugaugacacagg

SEQ ID NO: 1555 - RNA, 19 nt, Artificial Sequence
  source: /note="Description of Artificial Sequence: Synthetic oligonucleotide"
ggccuggaugaccucauca

SEQ ID NO: 1556 - RNA, 19 nt, Artificial Sequence
  source: /note="Description of Artificial Sequence: Synthetic oligonucleotide"
ugaugaggucauccaggcc

SEQ ID NO: 1557 - RNA, 19 nt, Artificial Sequence
  source: /note="Description of Artificial Sequence: Synthetic oligonucleotide"
cagcaucugggaccgcaga

SEQ ID NO: 1558 - RNA, 19 nt, Artificial Sequence
  source: /note="Description of Artificial Sequence: Synthetic oligonucleotide"
ucugcggucccagaugcug

SEQ ID NO: 1559 - RNA, 19 nt, Artificial Sequence
  source: /note="Description of Artificial Sequence: Synthetic oligonucleotide"
gcacaggcaucaaguucua

SEQ ID NO: 1560 - RNA, 19 nt, Artificial Sequence
  source: /note="Description of Artificial Sequence: Synthetic oligonucleotide"
uagaacuugaugccugugc

SEQ ID NO: 1561 - RNA, 19 nt, Artificial Sequence
  source: /note="Description of Artificial Sequence: Synthetic oligonucleotide"
accugggcuguggugcaaa

SEQ ID NO: 1562 - RNA, 19 nt, Artificial Sequence
  source: /note="Description of Artificial Sequence: Synthetic oligonucleotide"
uuugcaccacagcccaggu

SEQ ID NO: 1563 - RNA, 19 nt, Artificial Sequence
  source: /note="Description of Artificial Sequence: Synthetic oligonucleotide"
aagcuugggugucaucuca

SEQ ID NO: 1564 - RNA, 19 nt, Artificial Sequence
  source: /note="Description of Artificial Sequence: Synthetic oligonucleotide"
ugagaugacacccaagcuu

SEQ ID NO: 1565 - RNA, 19 nt, Artificial Sequence
  source: /note="Description of Artificial Sequence: Synthetic oligonucleotide"
uugggugucaucucagaca

SEQ ID NO: 1566 - RNA, 19 nt, Artificial Sequence
  source: /note="Description of Artificial Sequence: Synthetic oligonucleotide"
ugucugagaugacacccaa

SEQ ID NO: 1567 - RNA, 19 nt, Artificial Sequence
  source: /note="Description of Artificial Sequence: Synthetic oligonucleotide"
acaaccugcuggugacuga

SEQ ID NO: 1568 - RNA, 19 nt, Artificial Sequence
  source: /note="Description of Artificial Sequence: Synthetic oligonucleotide"
ucagucaccagcagguugu

SEQ ID NO: 1569 - RNA, 19 nt, Artificial Sequence
  source: /note="Description of Artificial Sequence: Synthetic oligonucleotide"
gacuggcggccagggcugu

SEQ ID NO: 1570 - RNA, 19 nt, Artificial Sequence
  source: /note="Description of Artificial Sequence: Synthetic oligonucleotide"
acagcccuggccgccaguc

SEQ ID NO: 1571 - RNA, 19 nt, Artificial Sequence
  source: /note="Description of Artificial Sequence: Synthetic oligonucleotide"
gugucuccuuuugggaccu

SEQ ID NO: 1572 - RNA, 19 nt, Artificial Sequence
  source: /note="Description of Artificial Sequence: Synthetic oligonucleotide"
aggucccaaaaggagacac

SEQ ID NO: 1573 - RNA, 19 nt, Artificial Sequence
  source: /note="Description of Artificial Sequence: Synthetic oligonucleotide"
uguuacagacagucuaccu

SEQ ID NO: 1574 - RNA, 19 nt, Artificial Sequence
  source: /note="Description of Artificial Sequence: Synthetic oligonucleotide"
agguagacugucuguaaca

SEQ ID NO: 1575 - RNA, 19 nt, Artificial Sequence
  source: /note="Description of Artificial Sequence: Synthetic oligonucleotide"
ccuggggaagaacagugaa

SEQ ID NO: 1576 - RNA, 19 nt, Artificial Sequence
  source: /note="Description of Artificial Sequence: Synthetic oligonucleotide"
uucacuguucuuccccagg

SEQ ID NO: 1577 - RNA, 19 nt, Artificial Sequence
  source: /note="Description of Artificial Sequence: Synthetic oligonucleotide"
gaggcccagccugcccgca

SEQ ID NO: 1578 - RNA, 19 nt, Artificial Sequence
  source: /note="Description of Artificial Sequence: Synthetic oligonucleotide"
ugcgggcaggcugggccuc

SEQ ID NO: 1579 - RNA, 19 nt, Artificial Sequence
  source: /note="Description of Artificial Sequence: Synthetic oligonucleotide"
gccagauccuggugcugga

SEQ ID NO: 1580 - RNA, 19 nt, Artificial Sequence
  source: /note="Description of Artificial Sequence: Synthetic oligonucleotide"
uccagcaccaggaucuggc

SEQ ID NO: 1581 - RNA, 19 nt, Artificial Sequence
  source: /note="Description of Artificial Sequence: Synthetic oligonucleotide"
cuggugcuggacaacgcua

SEQ ID NO: 1582 - RNA, 19 nt, Artificial Sequence
  source: /note="Description of Artificial Sequence: Synthetic oligonucleotide"
uagcguuguccagcaccag

SEQ ID NO: 1583 - RNA, 19 nt, Artificial Sequence
  source: /note="Description of Artificial Sequence: Synthetic oligonucleotide"
ugccauugucugcaacuuu

SEQ ID NO: 1584 - RNA, 19 nt, Artificial Sequence
  source: /note="Description of Artificial Sequence: Synthetic oligonucleotide"
aaaguugcagacaauggca

SEQ ID NO: 1585 - RNA, 19 nt, Artificial Sequence
  source: /note="Description of Artificial Sequence: Synthetic oligonucleotide"
cucugugcuggagaagcua

SEQ ID NO: 1586 - RNA, 19 nt, Artificial Sequence
  source: /note="Description of Artificial Sequence: Synthetic oligonucleotide"
uagcuucuccagcacagag

SEQ ID NO: 1587 - RNA, 19 nt, Artificial Sequence
  source: /note="Description of Artificial Sequence: Synthetic oligonucleotide"
uggacugagcgcagggccu

SEQ ID NO: 1588 - RNA, 19 nt, Artificial Sequence
  source: /note="Description of Artificial Sequence: Synthetic oligonucleotide"
aggcccugcgcucagucca

SEQ ID NO: 1589 - RNA, 19 nt, Artificial Sequence
  source: /note="Description of Artificial Sequence: Synthetic oligonucleotide"
ccuccuugcccaggcagga

SEQ ID NO: 1590 - RNA, 19 nt, Artificial Sequence
  source: /note="Description of Artificial Sequence: Synthetic oligonucleotide"
uccugccugggcaaggagg

SEQ ID NO: 1591 - RNA, 19 nt, Artificial Sequence
  source: /note="Description of Artificial Sequence: Synthetic oligonucleotide"
uugcccaggcaggaggcua

SEQ ID NO: 1592 - RNA, 19 nt, Artificial Sequence
  source: /note="Description of Artificial Sequence: Synthetic oligonucleotide"
uagccuccugccugggcaa

SEQ ID NO: 1593 - RNA, 19 nt, Artificial Sequence
  source: /note="Description of Artificial Sequence: Synthetic oligonucleotide"
cuggggugcugugugggga

SEQ ID NO: 1594 - RNA, 19 nt, Artificial Sequence
  source: /note="Description of Artificial Sequence: Synthetic oligonucleotide"
uccccacacagcaccccag

SEQ ID NO: 1595 - RNA, 19 nt, Artificial Sequence
  source: /note="Description of Artificial Sequence: Synthetic oligonucleotide"
gggccaaugcacugaaccu

SEQ ID NO: 1596 - RNA, 19 nt, Artificial Sequence
  source: /note="Description of Artificial Sequence: Synthetic oligonucleotide"
agguucagugcauuggccc

SEQ ID NO: 1597 - RNA, 19 nt, Artificial Sequence
  source: /note="Description of Artificial Sequence: Synthetic oligonucleotide"
caaugcacugaaccuggaa

SEQ ID NO: 1598 - RNA, 19 nt, Artificial Sequence
  source: /note="Description of Artificial Sequence: Synthetic oligonucleotide"
uuccagguucagugcauug

SEQ ID NO: 1599 - RNA, 19 nt, Artificial Sequence
  source: /note="Description of Artificial Sequence: Synthetic oligonucleotide"
uugggggaaagagccgagu

SEQ ID NO: 1600 - RNA, 19 nt, Artificial Sequence
  source: /note="Description of Artificial Sequence: Synthetic oligonucleotide"
acucggcucuuucccccaa

SEQ ID NO: 1601 - RNA, 19 nt, Artificial Sequence
  source: /note="Description of Artificial Sequence: Synthetic oligonucleotide"
aguaucuuccagccgcuga

SEQ ID NO: 1602 - RNA, 19 nt, Artificial Sequence
  source: /note="Description of Artificial Sequence: Synthetic oligonucleotide"
ucagcggcuggaagauacu

SEQ ID NO: 1603 - RNA, 19 nt, Artificial Sequence
  source: /note="Description of Artificial Sequence: Synthetic oligonucleotide"
cgcugccuccugacuguaa

SEQ ID NO: 1604 - RNA, 19 nt, Artificial Sequence
  source: /note="Description of Artificial Sequence: Synthetic oligonucleotide"
uuacagucaggaggcagcg

SEQ ID NO: 1605 - RNA, 19 nt, Artificial Sequence
  source: /note="Description of Artificial Sequence: Synthetic oligonucleotide"
aauaauauuaaacuuuuuu

SEQ ID NO: 1606 - RNA, 19 nt, Artificial Sequence
  source: /note="Description of Artificial Sequence: Synthetic oligonucleotide"
aaaaaaguuuaauauuauu

SEQ ID NO: 1607 - RNA, 19 nt, Artificial Sequence
  source: /note="Description of Artificial Sequence: Synthetic oligonucleotide"
uuaaaaaaccauaucauca

SEQ ID NO: 1608 - RNA, 19 nt, Artificial Sequence
  source: /note="Description of Artificial Sequence: Synthetic oligonucleotide"
ugaugauaugguuuuuuaa

SEQ ID NO: 1609 - RNA, 19 nt, Artificial Sequence
  source: /note="Description of Artificial Sequence: Synthetic oligonucleotide"
ucaucugucaggcacuuua

SEQ ID NO: 1610 - RNA, 19 nt, Artificial Sequence
  source: /note="Description of Artificial Sequence: Synthetic oligonucleotide"
uaaagugccugacagauga

We claim:

1. A double stranded ribonucleic acid (RNAi) agent for inhibiting expression of a sterol regulatory element binding protein (SREBP) chaperone (SCAP) gene, wherein the dsRNA agent comprises a sense strand and an antisense strand forming a double stranded region, and
    wherein the antisense strand comprises a region of complementarity to an mRNA encoding SCAP, wherein the region of complementarity comprises at least 15 contiguous nucleotides differing by no more than 3 nucleotides from nucleotides 1132-1156 of SEQ ID NO:1.

2. The double stranded RNAi agent of claim 1, wherein the double stranded RNAi agent comprises at least one modified nucleotide.

3. The double stranded RNAi agent of claim 2, wherein at least one of the modified nucleotides is selected from the group consisting of a deoxy-nucleotide, a 3'-terminal deoxythymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a 5'-phosphorothioate group, a nucleotide comprising a 5'-methylphosphonate group, a nucleotide comprising a 5' phosphate or 5' phosphate mimic, a nucleotide comprising vinyl phosphate, a nucleotide comprising adenosine-glycol nucleic acid (GNA), a nucleotide comprising thymidine-glycol nucleic acid (GNA) S-Isomer, a nucleotide comprising 2-hydroxymethyl-tetrahydrofurane-5-phosphate, a nucleotide comprising 2'-deoxythymidine-3'phosphate, a nucleotide comprising 2'-deoxyguanosine-3'-phosphate, and a terminal nucleotide linked to a cholesteryl derivative and a dodecanoic acid bisdecylamide group.

4. The double stranded RNAi agent of claim 2, further comprising at least one phosphorothioate internucleotide linkage.

5. The double stranded RNAi agent of claim 1, wherein the region of complementarity is at least 17 nucleotides in length; 19-23 nucleotides in length; or 19 nucleotides in length.

6. The double stranded RNAi agent of claim 1, wherein each strand is no more than 30 nucleotides in length.

7. The double stranded RNAi agent of claim 1, wherein at least one strand comprises a 3' overhang of at least 1 nucleotide; or a 3' overhang of at least 2 nucleotides.

8. The double stranded RNAi agent of claim 1, wherein the double stranded RNAi agent further comprises a ligand.

9. The double stranded RNAi agent of claim 8, wherein the ligand is

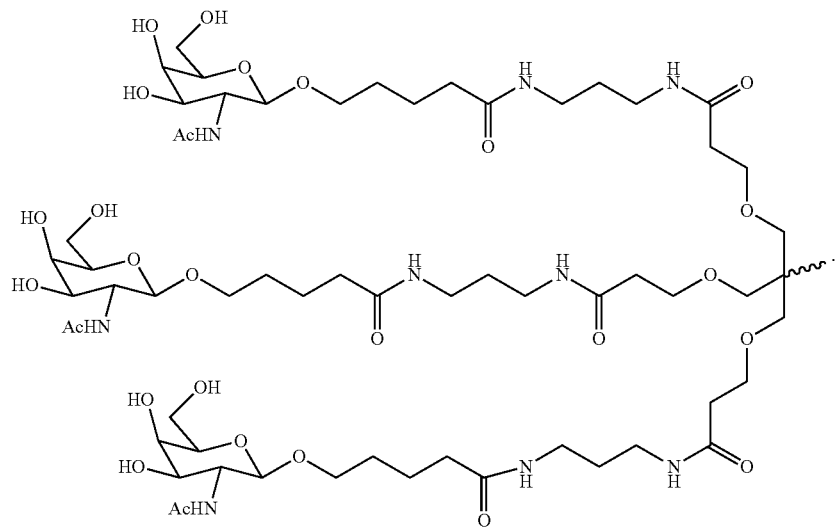 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

10. The double stranded RNAi agent of claim 8, wherein the double stranded RNAi agent is conjugated to the ligand as shown in the following schematic

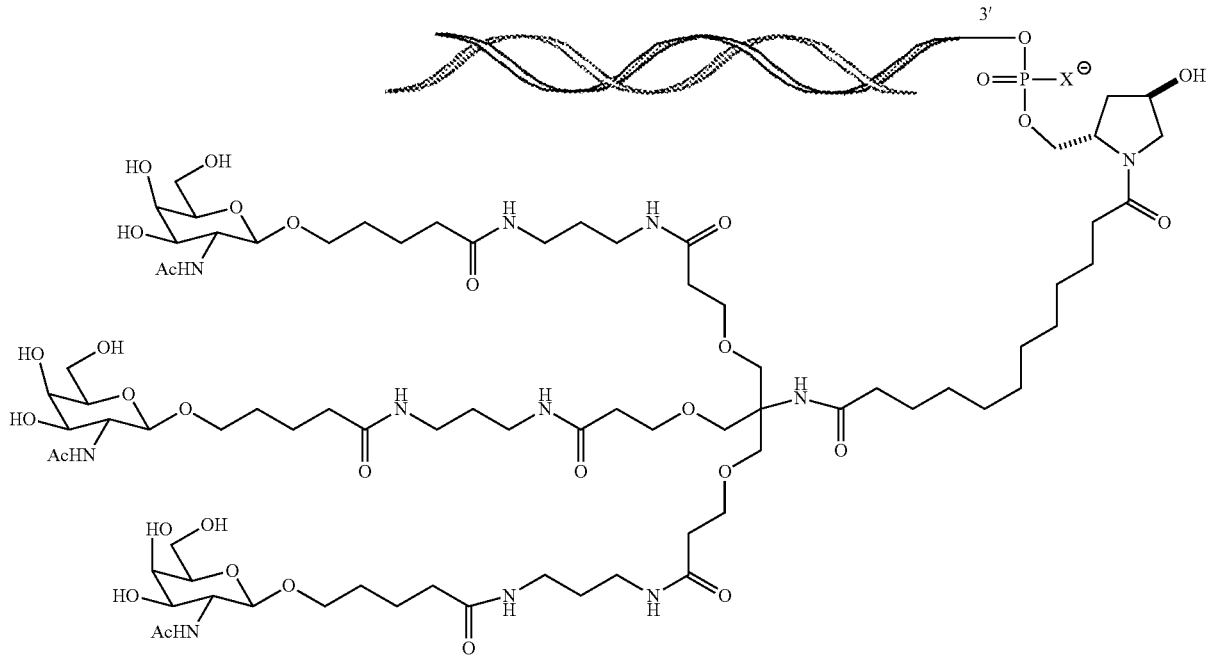

and, wherein X is O or S.

11. The double stranded RNAi agent of claim 10, wherein the X is O.

12. The double stranded RNAi agent of claim 8, wherein the ligand is a cholesterol.

13. A double stranded ribonucleic acid (RNAi) agent for inhibiting expression of a sterol regulatory element binding protein (SREBP) chaperone (SCAP) gene, wherein said double stranded RNAi agent comprises a sense strand complementary to an antisense strand, wherein said antisense strand comprises a region complementary to nucleotides 1132-1156 of SEQ ID NO:1, wherein each strand is about 14 to about 30 nucleotides in length, wherein said double stranded RNAi agent is represented by formula (III):

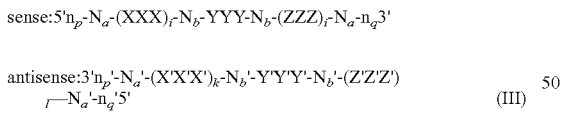

wherein:
j, k, and l are each independently 0 or 1;
p, p', q, and q' are each independently 0-6;
each $N_a$ and $N_a'$ independently represents an oligonucleotide sequence comprising 0-25 nucleotides which are either modified or unmodified or combinations thereof, each sequence comprising at least two differently modified nucleotides;
each $N_b$ and $N_b'$ independently represents an oligonucleotide sequence comprising 0-10 nucleotides which are either modified or unmodified or combinations thereof;
each $n_p$, $n_p'$, $n_q$, and $n_q'$, each of which may or may not be present, independently represents an overhang nucleotide;
XXX, YYY, ZZZ, X'X'X', Y'Y'Y', and Z'Z'Z' each independently represent one motif of three identical modifications on three consecutive nucleotides;

modifications on $N_b$ differ from the modification on Y and modifications on $N_b'$ differ from the modification on Y'; and wherein the sense strand is conjugated to at least one ligand.

14. The double stranded RNAi agent of claim 13, wherein formula (III) is represented by formula (IIIa):

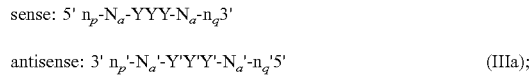

wherein formula (III) is represented by formula (IIIb):

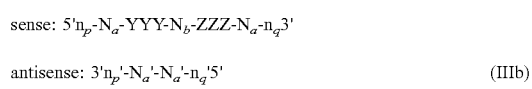

wherein each $N_b$ and $N_b'$ independently represents an oligonucleotide sequence comprising 1-5 modified nucleotides;

wherein formula (III) is represented by formula (IIIc):

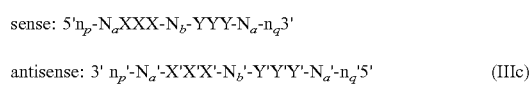

wherein each $N_b$ and $N_b'$ independently represents an oligonucleotide sequence comprising 1-5 modified nucleotides; or wherein formula (III) is represented by formula (IIId):

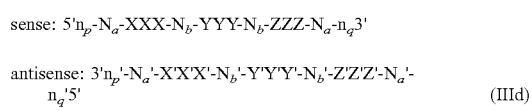

wherein each $N_b$ and $N_b'$ independently represents an oligonucleotide sequence comprising 1-5 modified nucleotides and each $N_a$ and $N_a'$ independently represents an oligonucleotide sequence comprising 2-10 modified nucleotides.

15. The double stranded RNAi agent of claim 13, wherein the double stranded region is 15-30 nucleotide pairs in length; 17-23 nucleotide pairs in length; 17-25 nucleotide pairs in length; 23-27 nucleotide pairs in length; 19-21 nucleotide pairs in length; or 21-23 nucleotide pairs in length.

16. The double stranded RNAi agent of claim 13, wherein the modifications on the nucleotides are selected from the group consisting of LNA, HNA, CeNA, 2'-methoxyethyl, 2'-O-alkyl, 2'-O-allyl, 2'-C-allyl, 2'-fluoro, 2'-deoxy, 2'-hydroxyl, and combinations thereof.

17. The double stranded RNAi agent of claim 13, wherein the ligand is one or more GalNAc derivatives attached through a bivalent or trivalent branched linker; or a cholesterol.

18. The double stranded RNAi agent of claim 13, wherein said agent further comprises at least one phosphorothioate or methylphosphonate internucleotide linkage.

19. A cell containing the double stranded RNAi agent of claim 1 or 13.

20. A pharmaceutical composition for inhibiting expression of a SCAP gene comprising the double stranded RNAi agent of claim 1.

21. A method of inhibiting for inhibiting expression of a sterol regulatory element binding protein (SREBP) chaperone (SCAP) gene in a cell, the method comprising:
    (a) contacting the cell with the double stranded RNAi agent of claim 1 or the pharmaceutical composition of claim 20; and
    (b) maintaining the cell produced in step (a) for a time sufficient to obtain degradation of the mRNA transcript of a SCAP gene, thereby inhibiting expression of the SCAP gene in the cell.

22. The method of claim 21, wherein said cell is within a subject.

23. The method of claim 22, wherein the subject is a human.

24. The method of claim 23, wherein the human subject suffers from a SCAP-associated disorder.

25. The method of claim 24, wherein the SCAP-associated disease is nonalcoholic fatty liver disease (NAFLD; fatty liver (steatosis); or nonalcoholic steatohepatitis (NASH).

26. The method of claim 21, wherein the SCAP expression is inhibited by at least about 30%.

27. A method of treating a subject having a disorder that would benefit from a reduction in SCAP expression, comprising administering to the subject a therapeutically effective amount of the double stranded RNAi agent of claim 1 or the pharmaceutical composition of claim 20, thereby treating said subject.

28. The method of claim 27, wherein the subject suffers from a SCAP-associated disorder.

29. The method of claim 27, wherein the subject is a human.

30. The method of claim 28, wherein the SCAP-associated disease is nonalcoholic fatty liver disease (NAFLD); fatty liver (steatosis); nonalcoholic steatohepatitis (NASH).

31. The method of claim 27, wherein the SCAP expression is inhibited by at least about 30%.

32. The method of claim 27, further comprising administering an additional therapeutic agent to the subject.

33. The method of claim 27, wherein the double stranded RNAi agent is administered at a dose of about 0.01 mg/kg to about 50 mg/kg.

34. The method of claim 27, wherein the double stranded RNAi agent is administered to the subject subcutaneously.

35. The method of claim 27, wherein the administration of the double stranded RNAi to the subject causes a decrease in one or more serum lipid and a decrease in SCAP protein accumulation; PNPLA3 protein accumulation; or SREBP double stranded RNAi accumulation.

36. A kit for inhibiting expression of a SCAP gene , comprising
    a) the double stranded RNAi agent of claim 1 or 13, and
    b) instructions for use, and
    c) optionally, means for administering the double stranded RNAi agent to the subject.

37. The double stranded RNAi agent of claim 1, wherein the antisense strand comprises the nucleotide sequence 5'-UAUGUAGGCAAACAAGAUGAUGU-3' (SEQ ID NO:194).

38. The double stranded RNAi agent of claim 1, wherein the antisense strand comprises the nucleotide sequence 5'-UAGAUGUAGGCAAACAAGAUGAU-3' (SEQ ID NO:196).

39. The double stranded RNAi agent of claim 1, wherein the antisense strand comprises the nucleotide sequence 5'-AGUAGAUGUAGGCAAACAAGAUG-3' (SEQ ID NO:198).

40. The double stranded RNAi agent of claim 37, wherein the sense strand comprises the nucleotide sequence 5'-AUCAUCUUGUUUGCCUACAUA-3' (SEQ ID NO:193) and the antisense strand comprises the nucleotide sequence 5'-UAUGUAGGCAAACAAGAUGAUGU-3' (SEQ ID NO:194).

41. The double stranded RNAi agent of claim 38, wherein the sense strand comprises the nucleotide sequence 5'-CAUCUUGUUUGCCUACAUCUAA-3' (SEQ ID NO:195) and the antisense strand comprises the nucleotide sequence 5'-UAGAUGUAGGCAAACAAGAUGAU-3' (SEQ ID NO:196).

42. The double stranded RNAi agent of claim 39, wherein the sense strand comprises the nucleotide sequence 5'-UCUUGUUUGCCUACAUCUACU-3' (SEQ ID NO:197) and the antisense strand comprises the nucleotide sequence 5'-AGUAGAUGUAGGCAAACAAGAUG-3' (SEQ ID NO:198).

43. The double stranded RNAi agent of claim 8, wherein the ligand is an N-acetylgalactosamine (GalNAc) derivative conjugated to the 3' end of the sense strand through a monovalent or branched bivalent or trivalent linker.

44. A pharmaceutical composition for inhibiting expression of a SCAP gene comprising the double stranded RNAi agent of claim 13.

45. A method of inhibiting for inhibiting expression of a sterol regulatory element binding protein (SREBP) chaperone (SCAP) gene in a cell, the method comprising:
    (a) contacting the cell with the double stranded RNAi agent of claim 13 or the pharmaceutical composition of claim 44; and
    (b) maintaining the cell produced in step (a) for a time sufficient to obtain degradation of the mRNA transcript of a SCAP gene, thereby inhibiting expression of the SCAP gene in the cell.

46. The method of claim 45, wherein said cell is within a subject.

47. The method of claim 46, wherein the subject is a human.

48. The method of claim 47, wherein the human subject suffers from a SCAP-associated disorder.

49. The method of claim 48, wherein the SCAP-associated disease is nonalcoholic fatty liver disease (NAFLD; fatty liver (steatosis); or nonalcoholic steatohepatitis (NASH).

50. The method of claim 45, wherein the SCAP expression is inhibited by at least about 30%.

51. A method of treating a subject having a disorder that would benefit from a reduction in SCAP expression, comprising administering to the subject a therapeutically effective amount of the double stranded RNAi agent of claim 13 or the pharmaceutical composition of claim 44, thereby treating said subject.

52. The method of claim 51, wherein the subject suffers from a SCAP-associated disorder.

53. The method of claim 51, wherein the subject is a human.

54. The method of claim 52, wherein the SCAP-associated disease is nonalcoholic fatty liver disease (NAFLD); fatty liver (steatosis); nonalcoholic steatohepatitis (NASH).

55. The method of claim 51, wherein the SCAP expression is inhibited by at least about 30%.

56. The method of claim 51, further comprising administering an additional therapeutic agent to the subject.

57. The method of claim 51, wherein the double stranded RNAi agent is administered at a dose of about 0.01 mg/kg to about 50 mg/kg.

58. The method of claim 51, wherein the double stranded RNAi agent is administered to the subject subcutaneously.

59. The method of claim 51, wherein the administration of the double stranded RNAi to the subject causes a decrease in one or more serum lipid and a decrease in SCAP protein accumulation; PNPLA3 protein accumulation; or SREBP double stranded RNAi accumulation.

* * * * *